(12) United States Patent
Yang et al.

(10) Patent No.: US 9,005,946 B2
(45) Date of Patent: Apr. 14, 2015

(54) VARIANT ENDOGLUCANASES AND RELATED POLYNUCLEOTIDES

(75) Inventors: Jie Yang, Foster City, CA (US); Xiyun Zhang, Fremont, CA (US); Ish Kumar Dhawan, Foster City, CA (US); Andrew Shaw, San Francisco, CA (US)

(73) Assignee: Codexis, Inc., Redwood City, CA (US)

( * ) Notice: Subject to any disclaimer, the term of this patent is extended or adjusted under 35 U.S.C. 154(b) by 692 days.

(21) Appl. No.: 13/203,909

(22) PCT Filed: Mar. 10, 2010

(86) PCT No.: PCT/US2010/026823
§ 371 (c)(1),
(2), (4) Date: Sep. 26, 2011

(87) PCT Pub. No.: WO2010/107644
PCT Pub. Date: Sep. 23, 2010

(65) Prior Publication Data
US 2012/0009631 A1    Jan. 12, 2012

Related U.S. Application Data

(60) Provisional application No. 61/161,018, filed on Mar. 17, 2009.

(51) Int. Cl.
C12P 7/10      (2006.01)
C12P 19/12     (2006.01)
C12P 19/14     (2006.01)
C12N 9/42      (2006.01)

(52) U.S. Cl.
CPC ................. *C12N 9/2437* (2013.01); *C12P 7/10* (2013.01); *C12P 19/12* (2013.01); *C12P 19/14* (2013.01); *C12Y 302/01091* (2013.01); *C12Y 302/01004* (2013.01); *Y02E 50/16* (2013.01); *Y02E 50/17* (2013.01)

(58) Field of Classification Search
CPC ... C12Y 302/01004; C12P 7/10; C12P 19/12; C12P 19/14
See application file for complete search history.

(56) References Cited

U.S. PATENT DOCUMENTS 4,486,553 A    12/1984    Wesch
4,683,202 A     7/1987    Mullis (Continued)

FOREIGN PATENT DOCUMENTS

EP       0137280           3/1992
WO       03/075129 A2      3/1992

(Continued)

OTHER PUBLICATIONS

Sakka, M., et al., 2010, "Analysis of a *Clostridium josui* cellulase gene cluster containing the man5A gene and characterization of recombinant Man5A", Bioscience, Biotechnology, Biochemistry, vol. 74, pp. 2077-2082.*

(Continued)

*Primary Examiner* — Manjunath Rao
*Assistant Examiner* — William W Moore
(74) *Attorney, Agent, or Firm* — Codexis, Inc.

(57) ABSTRACT

The invention provides variants of the *Clostridium thermocellum* endoglucanase (CelG) that have improved endoglucanase activity compared to the wild type enzyme. Also provided are related polynucleotides, compositions, vectors, host cells, and methods of use.

18 Claims, 6 Drawing Sheets

(56) References Cited

U.S. PATENT DOCUMENTS

| | | | |
|---|---|---|---|
| 5,426,039 | A | 6/1995 | Wallace et al. |
| 6,005,092 | A * | 12/1999 | Shoseyov et al. ............ 536/23.6 |
| 6,117,679 | A | 9/2000 | Stemmer |
| 6,376,246 | B1 | 4/2002 | Crameri et al. |
| 6,586,182 | B1 | 7/2003 | Patten et al. |
| 7,783,428 | B2 | 8/2010 | Gustafsson et al. |
| 2007/0111278 | A1 | 5/2007 | Koga et al. |
| 2007/0173431 | A1 * | 7/2007 | Day et al. ..................... 510/320 |
| 2007/0256197 | A1 | 11/2007 | Brumm |
| 2007/0281883 | A1 * | 12/2007 | Rosenfeld et al. ................ 514/8 |
| 2008/0220990 | A1 | 9/2008 | Fox |
| 2009/0280105 | A1 * | 11/2009 | Gusakov et al. ........... 424/94.61 |
| 2009/0312196 | A1 | 12/2009 | Colbeck et al. |
| 2009/0325240 | A1 * | 12/2009 | Daniell ........................ 435/101 |
| 2010/0086981 | A1 * | 4/2010 | LaTouf et al. ................ 435/139 |

FOREIGN PATENT DOCUMENTS

| | | | |
|---|---|---|---|
| WO | 95/22625 | A1 | 8/1995 |
| WO | 97/20078 | A1 | 6/1997 |
| WO | 97/35966 | A1 | 10/1997 |
| WO | 98/27230 | A1 | 6/1998 |
| WO | 99/01544 | A1 | 1/1999 |
| WO | 00/70031 | A1 | 11/2000 |
| WO | 01/75767 | A2 | 10/2001 |
| WO | 2008/042876 | A2 | 4/2008 |

OTHER PUBLICATIONS

Copeland, A., et al./Doe Joint Genome Institute, 2007, UniProt code GUNG_CLOTH, "Complete sequence of *Clostridium thermocellum* ATCC 27405", Endoglucanase G amino acid sequence, partial alignment.*

Lucas, S., et al./Doe Joint Genome Institute, 2009, UniProt code C7HI15_CLOTH, "The draft genome of *Clostridium thermocellum* DSM 2360", Glycoside hydrolase family 5 amino acid sequence, partial alignment.*

Belaich, A., et al., "Cel9M, a New Family 9 Cellulase of the *Clostridium cellulolyticum* Cellulosome," J. Bateriol., 184 (5):1378-1384 [2002].

Adams, S.P., et al., "Hindered dialkylamino nucleoside phosphite reagents in the synthesis of two DNA 51-mers," J. Am. Chem. Soc., 105:661 (1983).

Altschul, S.F., et al., "Gapped Blast and PSI-Blast: a new generation of protein database search programs," Nucleic Acids Res., 25(17):3389-3402 (1997).

Arnheim, N., et al., "Polymerase Chain Reaction," C&EN, pp. 36-47 (1990).

Barringer, K.J., et al., "Blunt-end and single-strand ligations by *Escherichia coli* ligase: influence on an in vitro amplification scheme," Gene, 89:117-122 (1990).

Beaucage, S.L., et al., "Deoxynucleoside phosphoamidites—A new class of key intermediates for deoxypolynucleotide synthesis," Tetrahedron Letters, 22(20):1859-62 (1981).

Boel, E., et al., "Two different types of intervening sequences in the glucoamylase gene from *Aspergillus niger*," EMBO J., 3(7):1581-1585 (1984).

Botstein, D., et al., "Strategies and applications of in vitro mutagenesis," Science, 229(4719):1193-1201 (1985).

Brigham, J.S., et al., "Hemicellulases: Diversity and Applications," in Handbook on Bioethanol (C. Wyman ed.) pp. 119-141, Taylor and Francis, Washington DC, (1995).

Carter, P., "Site-directed mutagenesis," Biochem. J., 237:1-7 (1986).

Caruthers, M.H., et al., "Chemical Synthesis and Biological Studies on Mutated Gene-control Regions," Cold Spring Harbor Symp. Quant. Biol., 47:411-418 (1982).

Case, M.E. et al., "Efficient transformation of *Neurospora crassa* by utilizing hybrid plasmid DNA," Proc. Natl. Acad. Sci. USA, 76(10):5259-5263 (1979).

Cheng, S., et al., "Long PCR," Nature, 369: 684-685 (1994).

Christians, F.C., et al., "Directed evolution of thymidine kinase for AZT phosphorylation using DNA family shuffling," Nature Biotechnology, 17:259-264 (1999).

Crameri, A., et al., "DNA shuffling of a family of genes from diverse species accelerates directed evolution," Nature, 391:288-291 (1998).

Crameri, A., et al., "Improved green fluorescent protein by molecular evolution using DNA shuffling," Nature Biotechnology, 14:315-319 (1996).

Crameri, A., et al., "Molecular evolution of an arsenate detoxification pathway by DNA shuffling," Nature Biotechnology, 15:436-438 (1997).

Dale, S.J., et al., "Oligonucleotide-directed random mutagenesis using the phosphorothioate method," Methods Mol. Biol., 57:369-74 (1996).

Dayhoff, M.O., et al., "A model of evolutionary change in proteins" in "Atlas of Protein Sequence and Structure," vol. 5, Suppl. 3 , pp. 345-352, Natl. Biomed. Res. Round., Washington, D.C. (1978).

Fox, R., "Directed molecular evolution by machine learning and the influence of nonlinear interactions," J. Theor. Biol. 234(2):187-199 (2005).

Fox, R., et al., "Optimizing the search algorithm for protein engineering by directed evolution," Protein Eng., 16 (8):589-597 (2003).

Guatelli, J.C., et al., "Isothermal, in virto amplification of nucleic acids by a multienzyme reaction modeled after retroviral replication," Proc. Natl. Acad. Sci. USA, 87:1874-1878 (1990).

Henaut, A., et al., "Analysis and predictions from *Escherichia coli* sequences, or *E. coli* in silico," in *Escherichia coli* and *Salmonella*, ASM Pres, Washington D.C., pp. 2047-2066 (1987).

Henikoff, S., et al. "Amino acid substitution matrices from protein blocks," Proc. Natl. Acad. Sci. USA, 89:10915-10919 (1992).

Johnstone, I.L., et al., "Cloning an *Aspergillus nidulans* developmental gene by transformation," EMBO J., 4 (5):1307-1311 (1985).

Kelly, J.M., et al., "Transformation of *Asoergillus niger* by the amdS gene of *Aspergillus nidulans*," EMBO J., 4 (2):475-479 (1985).

Kinsey, J.A., et al., "Transformation of *Neurospora crassa* with the Cloned am (Glutamate Dehydrogenase) Gene", Molecular and Cellular Biology, 4:117-122 (1984).

Kramer, B., et al., "Different base/base mismatches are corrected with different efficiencies by the methyl-directed DNA mismatch-repair system," Cell, 38:879-887 (1984).

Kwoh, D.Y. et al "Transcription-based amplification system and detection of amplified human immunodeficiency virus type 1 with a bead-based sandwich hybridization format," Proc. Natl. Acad. Sci. USA, 86:1173-1177 (1989).

Ladisch, M.R., et al., "Process considerations in the enzymatic hydrolysis of biomass," Enzyme Microb. Technol., 5:82 (1983).

Landegren, U., et al., "A Ligase-Mediated Gene Detection Technique," Science, 241:1077-1080 (1988).

Lemaire, M., et al., "Nucleotide Sequence of the celG Gene of *Clostridium thermocellum* and Characterization of Its Product, Endoglucanase CelG," J. Bact., 175(11):3353-3360 (1993).

Ling, M.M., et al., "Approaches to DNA mutagenesis: an overview," Anal. Biochem., 254(2):157-78 (1997).

Lomeli, H., et al., "Quantitative Assays Based on the Use of Replicatable Hybridization Probes," J. Clin. Chem, 35 (9): 1826-1831 (1989).

Matthes, H.W.D., et al., "Simultaneous rapid chemical synthesis of over one hundred oligonucleotides on a microscale," EMBO J., 3(4):801-05 (1984).

Minshull, J., et al., "Protein evolution by molecular breeding," Current Opinion in Chemical Biology, 3:284-290 (1999).

Nunberg, J.H., et al., "Molecular Cloning and Characterization of the Glucoamylase Gene of *Aspergillus awamori*," Mol. Cell Biol., 4(11):2306-2315 (1984).

Porath, J., "Immobilized metal ion affinity chromatography," Protein Expression and Purification, 3:263-281 (1992).

Ricciardelli, C., et al., "Development and characterization of primary cultures of smooth muscle cells from the fibromuscular stroma of the guinea pig prostate," In vitro Cell Dev. Biol., 25:1016-1024 (1989).

Robert, S.S., "Amplification of Nucleic Acid Sequences: The Choices Multiply," The Journal of NIH Research, 3:81-94 (1991).

Sheir-Neiss, G., et al., "Characterization of the secreted cellulases of *Trichoderma reesei* wild type and mutants during controlled fermentations," Appl. Microbiol. Biotechnol., 20:46-53 (1984).

(56) References Cited

OTHER PUBLICATIONS

Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Sooknanan, R., et al., "NASBRA: A detection and amplification system uniquely suited for RNA," Biotechnology, 13: 563-564 (1995).
Stemmer, W.P.C., "DNA shuffling by random fragmentation and reassembly: In vitro recombination for molecular evolution," Proc. Natl. Acad. Sci., U.S.A., 91:10747-10751 (1994).
Stemmer, W.P.C., "Rapid evolution of a protein in vitro by DNA shuffling," Nature, 370:389-391 (1994).
Suurnakki, A., et al., "*Trichoderma reesei* cellulases and their core domains in the hydrolysis and modification of chemical pulp," Cellulose, 7:189-209 (2004).
Tilburn, J., et al., "Transformation by integration in *Asperfillus nidulans*," Gene, 26:205-221 (1983).
Van Brunt, J., "Amplifying Genes: PCR and its alternatives," Biotechnology, 8:291-294 (1990).
Wells, J.A., et al., "Cassette mutagenesis: an efficient method for generation of multiple mutations at defined sites," Gene, 34:315-323 (1985).
Wilson, I.A., et al., "The structure of an antigenic determinant in a protein," Cell, 37:767-778 (1984).
Wu, D.Y., et al., "The Ligation Amplification Reaction (LAR)-Amplification of Specific DNA Sequences Using Sequential Rounds of Template-Dependent Ligation," Genomics, 4:560 (1989).
Yelton, M.M., et al., "Transformation of *Aspergillus nidulans* by using a trpC plasmid," Proc. Natl. Acad. Sci. USA, 81:1470-1474 (1984).
Zhang, J-H., et al., "Directed evolution of an effective fucosidase from a galactosidase by DNA shuffling and screening," Proc. Natl. Acad. Sci., U.S.A., 94:4504-4509.
Breves, R., et al., "Genes encoding two different beta-gludosidases of *Thermoanaerobacter brockii* are clustered in a common operon," Appl. Environ. Microbiology, 63(10):3902-3910 (1997).

* cited by examiner

```
ATGGTAGATAGTAATAATGATGACTGGCTGCATTGCAAAGGCAATAAAATCTACGATAT
GTACGGGAATGAAGTGTGGTTGACTGGTGCCAACTGGTTTGGCTTCAACTGCAGCGAGA
ACTGTTTTCATGGAGCGTGGTATGACGTGAAAACCATTCTCACAAGCATCGCCGACCGT
GGCATCAATCTGCTGCGTATTCCGATCTCCACGGAATTACTGTATTCTTGGATGATTGG
CAAGCCGAATCCAGTTTCCTCGGTAACCGCGAGTAACAATCCACCGTACCATGTAGTCA
ACCCGGACTTCTACGATCCTGAGACCGACGACGTTAAGAACAGCATGGAAATCTTCGAT
ATTATTATGGGGTACTGTAAAGAACTGGGCATCAAAGTTATGATCGATATCCACTCCCC
GGATGCTAATAATTCGGGGCACAATTATGAGCTGTGGTACGGCAAAGAAACCTCCACAT
GCGGTGTCGTGACCACAAAGATGTGGATTGACACTTTAGTATGGCTCGCTGATAAGTAT
AAAAATGACGACACCATCATCGCGTTTGATTTGAAAAACGAACCCCATGGTAAGCGTGG
CTACACGGCCGAAGTTCCCAAACTGCTGGCAAAGTGGGATAACTCCACCGATGAAAATA
ATTGGAAATACGCGGCCGAAACGTGTGCTAAAGCAATTTTGGAAGTGAACCCGAAGGTG
TTGATTGTTATCGAAGGGGTTGAACAATATCCGAAAACCGAAAAGGGTATACCTACGA
CACACCGGATATTTGGGGCGCGACAGGCGACGCTTCTCCGTGGTATTCAGCCTGGTGGG
GAGGTAACCTTCGTGGCGTCAAAGATTACCCGATTGATTTAGGCCCGCTGAACTCGCAG
ATCGTTTATAGTCCGCATGATTACGGACCGTCTGTATATGCGCAACCGTGGTTCGAGAA
AGACTTTACCATGCAGACGCTCTTGGATGATTATTGGTATGACACGTGGGCATACATCC
ATGACCAGGGTATTGCCCCAATTCTGATTGGGGAATGGGGTGGTCACATGGATGGGGC
AAAAATCAAAAATGGATGACGCTCTTACGTGATTATATCGTCCAGAATCGCATCCATCA
TACGTTCTGGTGTATCAACCCCAATAGTGGTGATACGGGCGGTTTACTTGGAAACGACT
GGTCTACCTGGGATGAAGCTAAATACGCGCTGCTTAAGCCGGCGCTGTGGCAGACCAAG
GATGGTAAATTCATCGGACTCGATCACAAAATTCCTCTGGGGTCGAAAGGGATTTCCCT
TGGAGAGTACTACGGCACCCCGCAAGCTAGCGACCGCCGGCAACACCGACCGCCACCC
CAACTAAACCTGCTGCGTCGTCAACGCCGAGTTTCATCTACGGTGACATCAACTCCGAT
GGGAATGTCAACAGCACCGATCTGGGCATCTTAAAACGCATTATCGTTAAAAACCCACC
AGCCTCTGCGAACATGGACGCTGCCGACGTCAATGCGGATGGAAAGGTCAATAGCACGG
ATTACACCGTGCTGAAGCGTTACTTATTGCGTTCCATTGACAAATTACCACACACAACA
```

FIG. 2

MVDSNNDDWLHCKGNKIYDMYGNEVWLTGANWFGFNCSENCFHGAWYDVKTILTSIADR
GINLLRIPISTELLYSWMIGKPNPVSSVTASNNPPYHVVNPDFYDPETDDVKNSMEIFD
IIMGYCKELGIKVMIDIHSPDANNSGHNYELWYGKETSTCGVVTTKMWIDTLVWLADKY
KNDDTIIAFDLKNEPHGKRGYTAEVPKLLAKWDNSTDENNWKYAAETCAKAILEVNPKV
LIVIEGVEQYPKTEKGYTYDTPDIWGATGDASPWYSAWWGGNLRGVKDYPIDLGPLNSQ
IVYSPHDYGPSVYAQPWFEKDFTMQTLLDDYWYDTWAYIHDQGIAPILIGEWGGHMDGG
KNQKWMTLLRDYIVQNRIHHTFWCINPNSGDTGGLLGNDWSTWDEAKYALLKPALWQTK
DGKFIGLDHKIPLGSKGISLGEYYGTPQASDPPATPTATPTKPAASSTPSFIYGDINSD
GNVNSTDLGILKRIIVKNPPASANMDAADVNADGKVNSTDYTVLKRYLLRSIDKLPHTT

FIG. 3

VARIANT ENDOGLUCANASES AND RELATED POLYNUCLEOTIDES

CROSS REFERENCE TO RELATED APPLICATIONS

This application claims benefit under 35 U.S.C. §119(e) of application Ser. No. 61/161,018, filed Mar. 17, 2009, the contents of which are incorporated herein by reference.

REFERENCE TO SEQUENCE LISTING, TABLE OR COMPUTER PROGRAM

The Sequence Listing submitted concurrently herewith under 37 C.F.R. §1.821 in a computer readable form (CFR) via EFS-Web as file name CX3_004WO1.txt is incorporated herein by reference. The electronic copy of the Sequence Listing was created on Mar. 10, 2010 with a file size of 1308 kilobytes.

FIELD OF THE INVENTION

The present invention relates to novel cellulases and methods for producing said cellulases. More specifically the invention relates to variant cellulases having improved properties and methods of using the novel cellulases and compositions of such cellulases in a variety of industrial processes.

BACKGROUND OF THE INVENTION

Cellulosic biomass is a significant renewable resource for the generation of sugars. Fermentation of these sugars can yield numerous end-products such as fuels and chemicals that are currently derived from petroleum. While the fermentation of sugars to fuels, such as ethanol is relatively straightforward, the hydrolytic conversion of cellulosic biomass to fermentable sugars such as glucose is difficult because of the crystalline structure of cellulose and its close association with lignin (Ladisch, et al., Enzyme Microb. Technol. 5:82 (1983)). Pretreatment, by means, including but not limited to, mechanical and solvent means, increases the susceptibility of cellulose to hydrolysis, presumably by breaking the lignin seal and disrupting the crystalline cellulose structure. This step may be followed by the enzymatic conversion of cellulose to glucose, cellobiose, cello-oligosaccharides and the like using enzymes that specialize in breaking up the β-1-4 glycosidic bonds of cellulose. These enzymes are collectively referred to as "cellulases".

Cellulases are divided into three sub-categories of enzymes: 1,4-β-D-glucan glucanohydrolase ("endoglucanase" or "EG"); 1,4-β-D-glucan cellobiohydrolase ("exoglucanase", "cellobiohydrolase", or "CBH"); and β-glucosidase (β-D-glucoside-glucohydrolase), ("cellobiase" or "BG"). These enzymes act in concert to catalyze the hydrolysis of cellulose containing substrates. Endoglucanases randomly attack the interior parts and mainly the amorphous regions of cellulose, mostly yielding glucose, cellobiose, and cellotriose. Exoglucanases incrementally shorten the glucan molecules by binding to the glucan ends and releasing mainly cellobiose units from the ends of the cellulose polymer. β-glucosidases split the cellobiose, a water-soluble β-1,4-linked dimer of glucose, into two units of glucose.

There are several types of microorganisms that produce cellulases. These include fungi, actinomycetes, and bacteria. Cellulases from strains of the filamentous fungi *Trichoderma* sp., *Penicillium* sp., and *Chrysosporium* sp. have been particularly productive in hydrolyzing cellulose and cellulases derived from these strains have been previously used to hydrolyze cellulose. However, the cost of producing these enzymes along with their hydrolytic inefficiency under certain industrial conditions has been a drawback.

In order to maximize the hydrolysis of cellulosic substrates and enable commercial routes to end-product production (e.g., biofuels), it would be highly desirable to develop new cellulases and particularly new endoglucanases useful in the saccharification of biomass (e.g., cellulose containing substrates).

SUMMARY OF THE INVENTION

The present invention has multiple aspects.

In one aspect, the invention relates to isolated endoglucanase polypeptide variants. In one embodiment, the variants comprise an amino acid sequence that is at least about 85% identical to the endoglucanase polypeptide of SEQ ID NO: 2 and having at least one amino acid substitution selected from the amino acid residue positions of V2, D3, D8, G14, Y18, M20, Y21, V25, S38, F42, A57, D58, I61, N62, I66, S90, H96, V97, D104, D109, M114, G122, N146, E148, K153, L173, D175, D180, A185, K204, L206, D214, T224, A226, E231, K235, V236, I238, V243, T254, D256, W270, K283, P286, I287, D288, L292, S294, I296, V297, M319, Y328, D329, I342, L343, H350, Q357, T361, L362, V368, Q369, R371, H373, L390, N392, E399, A403, K416, I418, K423, P425, K429, and/or L433, wherein amino acid position is determined by alignment with SEQ ID NO: 2. In another embodiment, the variants comprise at least one substitution selected from V2/F/G/K/H/R, D3G, D8E, G14A, Y18V, M20K, Y21N, V25M, S38R, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, W270F/Y/I, K283R, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, and/or L433I, wherein amino acid position is determined by alignment with SEQ ID NO: 2. In a further embodiment, the variants comprise an amino acid sequence encoded by a nucleic acid that hybridizes under stringent conditions over substantially the entire length of a nucleic acid corresponding to SEQ ID NO: 1 or a complementary sequence thereof, wherein the encoded amino acid sequence comprises at least one substitution selected from V2/F/G/K/H/R, D3G, D8E, G14A, Y18V, M20K, Y21N, V25M, S38R, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, W270F/Y/I, K283R, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, and/or L433I, wherein amino acid position is determined by alignment of the encoded amino acid sequence with SEQ ID NO: 2. In yet a further embodiment, the variants comprise an amino acid sequence that is at least about 90% identical to SEQ ID NO: 2 and having at least one substitution selected from Y18, I66, H96, D109, N146, E148, T224, E231, K235, W270, I342, V368, N392, K429, and/or L433, wherein amino acid position is determined by alignment with SEQ ID NO: 2. In yet another embodiment, the variant comprises at least a substitution at positions I66 and D109. In additional embodiments, the variants comprises at least one substitution selected from Y18V, I66V, H96Y, D109G/S, N146I/E/M, E148P, T224K, E231A, K235N, W270Y, and/or K429I/N.

In a second aspect, the invention relates to an isolated endoglucanase polypeptide comprising an amino acid sequence that is at least about 97% identical to SEQ ID NO: 4.

In a third aspect, the variants encompassed by the invention have an amino acid sequence that has a substitution, deletion, and/or insertion of from one to twenty amino acid residues in a sequence selected from the group of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, and 476, and/or wherein the variant has at least about 1.5-fold greater endoglucanase activity than native Clostridium thermocellum endoglucanase (CelGcat) (SEQ ID NO: 2), as measured in the assay of Example 7. In one embodiment, variants exhibit at least about 1.5-fold greater endoglucanase activity than wild type Clostridium thermocellum (SEQ ID NO: 2), as measured in the assay of Example 7B.

In a fourth aspect, the invention relates to a polynucleotide encoding any one of the variant endoglucanase polypeptide according to the invention. In one embodiment, the polynucleotide will be operably linked to a promoter to form a nucleic acid construct. In another embodiment, the invention relates to host cells comprising the nucleic acid construct.

In a fifth aspect, the invention relates to a method of producing a variant endoglucanase polypeptide comprising (a) culturing a host cell transformed with a endoglucanase polynucleotide encoding a variant according to the invention under conditions suitable for the expression of the variant; and (b) recovering the variant endoglucanase polypeptide from the culture medium or from the transformed and cultured host cells.

In a sixth aspect, the invention relates to a method of producing cellobiose and/or glucose comprising (a) providing a cellulose substrate and a variant endoglucanase polypeptide according to the invention; and (b) contacting the cellulose substrate with the endoglucanase polypeptide under conditions sufficient to form a reaction mixture for converting the cellulose to cellobiose. In some embodiments, a β-glucosidase will be included in the contacting step.

In a seventh aspect, the invention relates to enzyme compositions comprising an endoglucanase polypeptide encompassed by the invention. In one embodiment, the enzyme composition will include additional enzymes, such as additional cellulase enzymes.

In an eighth aspect, the invention relates to a method of converting a biomass substrate to a fermentable sugar comprising contacting a biomass substrate with an enzyme composition encompassed by the invention under conditions suitable for the production of the fermentable sugar. In some embodiments, the fermentable sugar will comprise glucose. In some embodiments, the biomass substrate will be pretreated.

In a ninth aspect, the invention relates to a method of producing a fermentation product comprising contacting a biomass substrate with an enzyme composition encompassed by the invention under conditions suitable for the production of the fermentable sugar, contacting the fermentable sugars with a fermenting microorganism to produce a fermentation product, and recovering the fermentation product. In some embodiments, the fermentation product will be an alcohol and in some preferred embodiments the alcohol will be ethanol. In other embodiments the contacting steps will be simultaneous.

BRIEF DESCRIPTION OF THE FIGURES

FIG. 2 depicts the codon optimized Clostridium thermocellum endoglucanase polynucleotide (SEQ ID NO: 477) which includes the catalytic domain represented by nucleic acids 1-1314 (corresponding to SEQ ID NO: 1) and a linker plus dockerin domain represented by nucleic acids 1315-1593. The linker and dockerin domains are in bold and underlined.

FIG. 3 depicts the corresponding mature EG polypeptide (SEQ ID NO: 478) encoded by the polynucleotide of SEQ ID NO: 477. The catalytic domain ("CelGcat") is represented by amino acid 1-438 (corresponding to SEQ ID NO: 2). The linker and dockerin domains are represented by amino acid 439-531 and are in bold and underlined.

FIG. 5A illustrates improved activity, FIG. 5B illustrates specific activity and FIG. 5C illustrates the pH profile. The CelGcat is represented by 2(WT), wherein "2" represents SEQ ID NO: 2. Each variant is represented by its sequence identifier, for example "244" means SEQ ID NO: 244. Error bars represent±1 Stdev. Experimental conditions for determination of activity and specific activity: 200 g/L Avicel, pH 4, 70° C., and 24 hrs. Experimental conditions for pH profile: 200 g/L Avicel, pH 3-8, 70° C., and 24 hrs.

DETAILED DESCRIPTION OF THE INVENTION

Definitions

Figure 1:
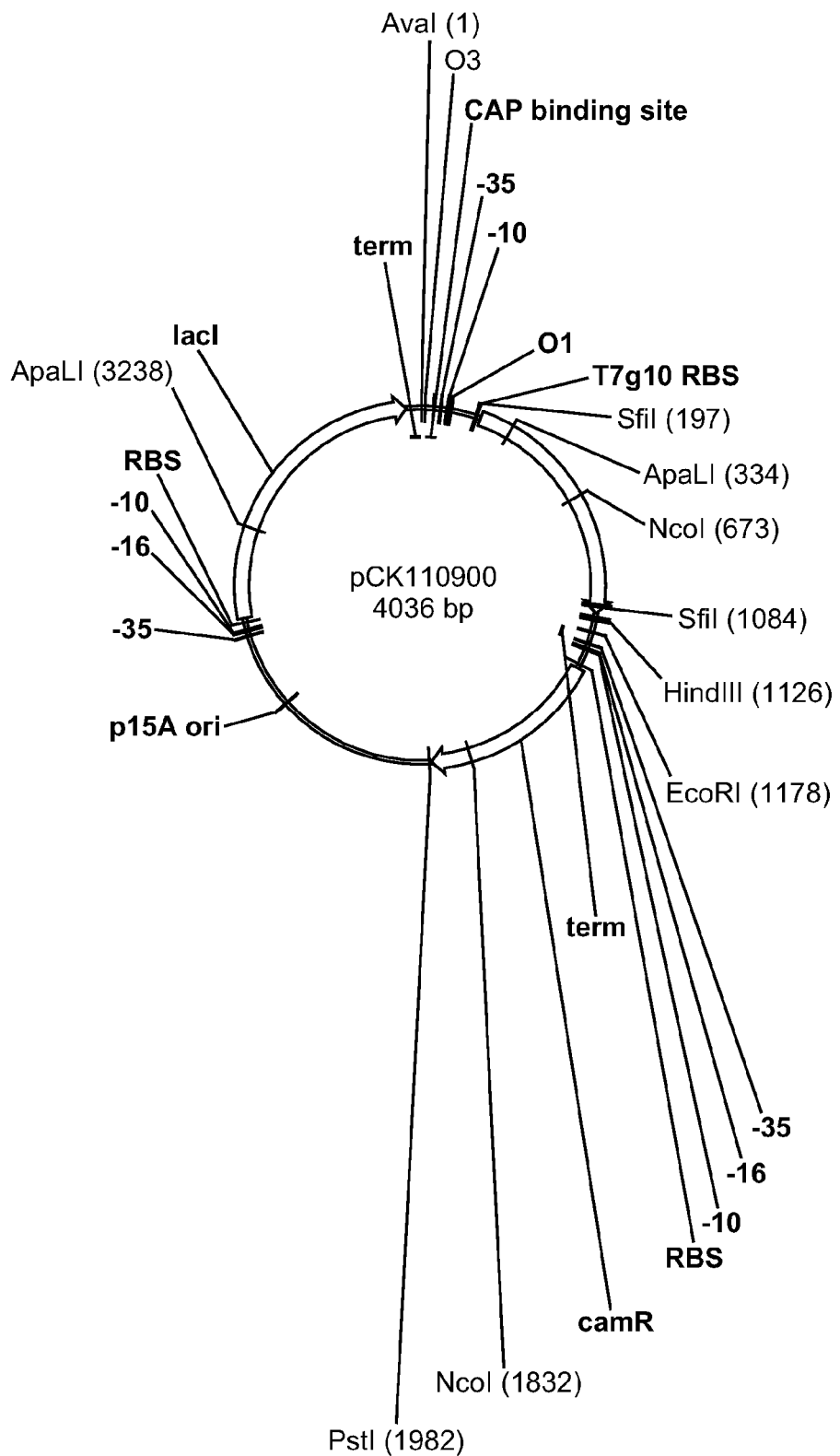
FIG. 1 is a 4036 bp expression vector (pCK110900) of the present invention comprising a P15A origin of replication (P15A ori), a CAP binding site, a lac promoter, a ribosomal binding site (T7g10 RBS), and a chloramphenicol resistance gene (camR).

Unless defined otherwise, all technical and scientific terms used herein generally have the same meaning as commonly understood by one of ordinary skill in the art to which this invention pertains. Generally, the nomenclature used herein and the laboratory procedures in cell culture, molecular genetics, organic chemistry and nucleic acid chemistry are those known in the art.

The term "cellulase" refers to a category of enzymes capable of hydrolyzing cellulose (β-1,4-glucan or β-D-glucosidic linkages) to shorter oligosaccharides, cellobiose and/or glucose.

The term "endoglucanase" or "EG" used interchangeably refers to a group of cellulase enzymes classified as E.C. 3.2.1.4. These cellulases hydrolyze internal β-1,4 glucosidic bonds of cellulose.

The term "EG polypeptide" refers herein to a polypeptide having EG activity.

The term "EG polynucleotide" refers to a polynucleotide encoding a polypeptide having EG activity.

"Cellulolytic activity" encompasses exoglucanase activity (CBH), endoglucanase (EG) activity and/or β-glucosidase activity.

The term "exoglucanase", "exo-cellobiohydrolase" or "CBH" refers to a group of cellulase enzymes classified as E.C. 3.2.1.91. These enzymes hydrolyze cellobiose from the reducing or non-reducing end of cellulose.

The term "β-glucosidase" refers to a group of cellulase enzymes classified as E.C. 3.2.1.21 that catalyze the hydrolysis of cellobiose to glucose As used herein, the term "isolated" refers to a nucleic acid, polynucleotide, polypeptide, protein, or other component that is partially or completely separated from components with which it is normally associated (other proteins, nucleic acids, cells, synthetic reagents, etc.).

A nucleic acid (such as a polynucleotide) or polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A protein expressed in vitro or in vivo from a recombinant polynucleotide is an example of a recombinant polypeptide. Likewise, a polynucleotide sequence that does not appear in nature, for example a variant of a naturally occurring gene, is recombinant.

The term "wild-type" or "native" used interchangeably herein as applied to a polypeptide (protein) means a polypeptide (protein) expressed by a naturally occurring microorganism such as bacteria or filamentous fungus found in nature.

A "variant" as used herein means an EG polypeptide or EG polynucleotide encoding the EG polypeptide comprising one or more modifications such as substitutions, deletions and/or truncations of one or more specific amino acid residues or of one or more specific nucleotides or codons in the polypeptide or polynucleotide. The term "variant" as used herein is one that does not appear in a naturally occurring polynucleotide or polypeptide.

As used herein "catalytic domain" refers to a structural region of a polypeptide which includes the active site for substrate hydrolysis.

The term "parent EG" as used herein means an EG to which modifications such as substitutions, deletions and/or truncations are made to produce the enzyme variants of the present invention. A parent EG may sometimes be a reference sequence or may sometimes be a naturally occurring (wild type) polypeptide.

A "reference EG sequence" refers to a defined sequence used as a basis for a sequence comparison. A reference EG sequence may be a subset of a larger sequence. Generally a reference sequence is at least 25 amino acid residues in length, at least 50 residues in length, at least 100 residues in length, at least 150 residues in length at least 200 residues in length, at least 300 residues in length, at least 350 residues in length or the full length of the polypeptide. For instance, a reference sequence based on SEQ ID NO: 2 having at the residue corresponding to A57 a valine, refers to a reference sequence in which the corresponding residue at A57 in SEQ ID NO: 2 has been changed to a valine.

An "improved property" refers to an EG polypeptide that exhibits an improvement in any property as compared to the CelGcat (SEQ ID NO: 2) or a reference EG polypeptide sequence. Improved properties may include but are not limited to increased protein expression, thermo-stability, thermo-activity, pH activity, pH stability, product specificity, increased specific activity, substrate specificity, increased resistance to substrate or end-product inhibition, altered temperature profile, and chemical stability.

The term "improved thermo-activity" as used herein means a variant displaying an increase in the rate of hydrolysis at elevated temperature and at the same time decreasing the time required and/or decreasing the amount of enzyme concentration required for hydrolysis as compared to a reference. Alternatively a variant with a reduced thermo-activity will catalyze a hydrolysis reaction at a temperature lower than the temperature optimum of the parent as defined by the temperature dependent activity profile of the parent.

"Corresponding to", "reference to" "or relative to" when used in the context of the numbering of a given amino acid or polynucleotide sequence refers to the numbering of the residues of a specified reference sequence when the given amino acid or polynucleotide sequence is compared to the reference sequence.

The phrase "a corresponding microorganism" used in the context of comparing a recombinant host cell or microorganism to a corresponding host cell or microorganism means that the corresponding host cell or microorganism has not been transformed with a polynucleotide encoding an EG encompassed by the invention but that the corresponding host cell or microorganism and the transformed or recombinant host cell or microorganism are cultured under essentially the same culture conditions.

The terms "percent identity," "% identity," "percent identical," and "% identical" are used interchangeably herein to refer to the percent amino acid sequence identity that is obtained by ClustalW analysis (version W 1.8 available from European Bioinformatics Institute, Cambridge, UK), counting the number of identical matches in the alignment and dividing such number of identical matches by the length of the reference sequence, and using the following default ClustalW parameters to achieve slow/accurate pairwise optimal alignments—Gap Open Penalty: 10; Gap Extension Penalty: 0.10; Protein weight matrix: Gonnet series; DNA weight matrix: IUB; Toggle Slow/Fast pairwise alignments=SLOW or FULL Alignment.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art. See e.g., Dayhoff et al. (1978), "A model of evolutionary change in proteins"; "Atlas of Protein Sequence and Structure," Vol. 5, Suppl. 3 (Ed. M. O. Dayhoff), pp. 345-352, *Natl. Biomed. Res. Round.*, Washington, D.C.; and Henikoff et al. (1992) *Proc. Natl. Acad. Sci. USA*, 89:10915-10919, both of which are incorporated herein by reference. The BLOSUM62 matrix is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acid position of each sequence at which the alignment begins and ends, and optionally by the insertion of a gap or multiple gaps in one or both sequences so as to arrive at the highest possible score. While optimal alignment and scoring can be accomplished manually, the process is facilitated by the use of a computer-implemented alignment algorithm, e.g., gapped BLAST 2.0, described in Altschul, et al. (1997) *Nucleic Acids Res.*, 25:3389-3402 (incorporated herein by reference), and made available to the public at the National Center for Biotechnology Information Website. Optimal alignments, including multiple alignments can be prepared using readily available programs such as PSI-BLAST, which is described by Altschul, et al. (1997) *Nucleic Acids Res.*, 25:3389-3402 and which is incorporated herein by reference.

With respect to an amino acid sequence that is aligned or optimally aligned with a reference sequence, an amino acid residue "corresponds to" the position in the reference sequence with which the residue is paired in the alignment.

The "position" is denoted by a number that sequentially identifies each amino acid in the reference sequence based on its position relative to the N-terminus Owing to deletions, insertions, truncations, fusions, and the like that must be taken into account when determining an optimal alignment, in general the amino acid residue number in a test sequence determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

Nucleic acids "hybridize" when they associate, typically in solution. Nucleic acids hybridize due to a variety of well-characterized physico-chemical forces, such as hydrogen bonding, solvent exclusion, base stacking and the like.

As used herein, the term "stringent hybridization wash conditions" in the context of nucleic acid hybridization experiments, such as Southern and Northern hybridizations, are sequence dependent, and are different under different environmental parameters. An extensive guide to the hybridization of nucleic acids is found in Tijssen (1993) "Laboratory Techniques in biochemistry and Molecular Biology-Hybridization with Nucleic Acid Probes," Part I, Chapter 2 (Elsevier, N.Y.), which is incorporated herein by reference. For purposes of the present invention, "highly stringent" (or "high stringency") hybridization and wash conditions are generally selected to be about 5° C. or less lower than the thermal melting point ($T_m$) for the specific sequence at a defined ionic strength and pH (as noted below, highly stringent conditions can also be referred to in comparative terms). The $T_m$ is the temperature (under defined ionic strength and pH) at which 50% of the test sequence hybridizes to a perfectly matched probe. Very stringent conditions are selected to be equal to the $T_m$ for a particular probe.

An example of stringent hybridization conditions for hybridization of complementary nucleic acids which have more than 100 complementary residues on a filter in a Southern or Northern blot is 50% formamide with 1 mg of heparin at 42° C., with the hybridization being carried out overnight. An example of stringent wash conditions is a 0.2×SSC wash at 65° C. for 15 minutes (see Sambrook, et al., Molecular Cloning—A Laboratory Manual" (1989) Cold Spring Harbor Laboratory (Cold Spring Harbor, N.Y.), which is incorporated herein by reference, for a description of SSC buffer). Often the high stringency wash is preceded by a low stringency wash to remove background probe signal. An example low stringency wash is 2×SSC at 40° C. for 15 minutes.

As noted, "highly stringent" conditions are selected to be about 5° C. or less lower than the thermal melting point ($T_m$) for the specific sequence at a defined ionic strength and pH. Target sequences that are closely related or identical to the nucleotide sequence of interest (e.g., "probe") can be identified under highly stringent conditions. Lower stringency conditions are appropriate for sequences that are less complementary. Stringent hybridization (as well as highly stringent, ultra-high stringency, or ultra-ultra high stringency hybridization conditions) and wash conditions can be readily determined empirically for any test nucleic acid. For example, in determining highly stringent hybridization and wash conditions, the hybridization and wash conditions are gradually increased (e.g., by increasing temperature, decreasing salt concentration, increasing detergent concentration and/or increasing the concentration of organic solvents, such as formamide, in the hybridization or wash), until a selected set of criteria are met. For example, the stringency of hybridization and wash conditions is gradually increased until a probe corresponding to SEQ ID NO: 1 or complementary sequence thereof, binds to a perfectly matched complementary target. A test nucleic acid is said to specifically hybridize to a probe nucleic acid when it hybridizes at least ½ as well to the probe as to the perfectly matched complementary target, e.g., with a signal to noise ratio at least ½ as high as hybridization of the probe to the target under conditions in which the perfectly matched probe binds to the perfectly matched complementary target.

Ultra high-stringency hybridization and wash conditions are those in which the stringency of hybridization and wash conditions are increased until the signal to noise ratio for binding of the probe to the perfectly matched complementary target nucleic acid is at least 10×. A target nucleic acid which hybridizes to a probe under such conditions, with a signal to noise ratio of at least ½ that of the perfectly matched complementary target nucleic acid is said to bind to the probe under ultra-high stringency conditions.

Similarly, even higher levels of stringency can be determined by gradually increasing the stringency of hybridization and/or wash conditions of the relevant hybridization assay. For example, those in which the stringency of hybridization and wash conditions are increased until the signal to noise ratio for binding of the probe to the perfectly matched complementary target nucleic acid is at least 10×, 20×, 50×, 100×, or 500×. A target nucleic acid which hybridizes to a probe under such conditions, with a signal to noise ratio of at least ½ that of the perfectly matched complementary target nucleic acid is said to bind to the probe under ultra-ultra-high stringency conditions.

In describing the various variants of the present invention, the nomenclature described below is adapted for ease of reference. In all cases the accepted IUPAC single letter or triple letter amino acid abbreviations are employed. For amino acid substitutions the following nomenclature is used: [Original amino acid, position, substituted amino acid]. Accordingly the substitution of serine with glycine at position 34 is designated "Ser34Gly" or "S34G".

The term "operably linked" refers herein to a configuration in which a control sequence is appropriately placed at a position relative to the coding sequence of the DNA sequence such that the control sequence influences the expression of a polypeptide.

When used herein, the term "coding sequence" is intended to cover a nucleotide sequence, which directly specifies the amino acid sequence of its protein product. The boundaries of the coding sequence are generally determined by an open reading frame, which usually begins with the ATG start codon. The coding sequence typically includes a DNA, cDNA, and/or recombinant nucleotide sequence.

As used herein, the term "expression" includes any step involved in the production of the polypeptide including, but not limited to, transcription, post-transcriptional modification, translation, post-translational modification, and secretion.

The term "expression vector" refers herein to a DNA molecule, linear or circular, that comprises a segment encoding a polypeptide of the invention, and which is operably linked to additional segments that provide for its transcription.

The term "construct", "DNA construct", or "nucleic acid construct" refers herein to a nucleic acid, either single- or double-stranded, which is isolated from a naturally occurring gene or which has been modified to contain segments of nucleic acids in a manner that would not otherwise exist in nature.

The term "nucleic acid construct" is synonymous with the term "expression cassette" and "expression vector" when the nucleic acid construct contains the control sequences required for expression of an endoglucanase coding sequence of the present invention.

The term "culturing" or "cultivation" refers to growing a population of microbial cells under suitable conditions in a liquid or solid medium. In some embodiments, culturing refers to fermentative bioconversion of a cellulosic substrate to an end-product.

The term "contacting" refers to a state of association which includes physical and/or chemical interactions. With respect to contacting an enzyme or enzyme composition with a substrate, the term refers to the placing of a respective enzyme in sufficiently close proximity to a respective substrate to enable the enzyme to convert the substrate to a product. Those skilled in the art will recognize that mixing a solution of the enzyme with the respective substrate will effect contacting.

As used herein the term "transformed" or "transformation" used in reference to a cell means a cell has a non-native nucleic acid sequence integrated into its genome or as an episomal plasmid that is maintained through multiple generations.

The term "introduced" in the context of inserting a nucleic acid sequence into a cell means transfected, transduced or transformed (collectively "transformed") and includes reference to the incorporation of a nucleic acid sequence into a eukaryotic or prokaryotic cell wherein the nucleic acid is incorporated into the genome of the cell.

The term "fermentable sugar" means simple sugars (monosaccharides, disaccharides and short oligosaccharides) such as, but not limited to glucose, xylose, galactose, arabinose, mannose and sucrose.

The term "biomass" or "cellulosic substrate" or "lignocellulosic substrate" all used interchangeably herein means a material that includes cellulose. Generally the material will also contain xylan, lignin, and complex carbohydrates such as starch.

The term "saccharification" means the process of converting complex carbohydrates such as starch and/or cellulose into fermentable sugars.

As used herein "a", "an", and "the" include plural references unless the context clearly dictates otherwise.

The term "comprising" and its cognates are used in their inclusive sense; that is, equivalent to the term "including" and its corresponding cognates.

Variant EG Polypeptides:

The present invention provides novel polypeptides having endoglucanase activity that are variants of the endoglucanase *Clostridium thermocellum* CelG (SEQ ID NO: 478) and/or variants of the EG CelG catalytic domain (CelGcat) (SEQ ID NO: 2). *Clostridium thermocellum* is a thermophilic anaerobic bacterium that secretes a number of enzymes in the form of a highly active cellulolytic complex called a cellulosome that is involved in the degradation of cellulose. Lemaire, et al., *J. Bacteriology* (June 1993) 175(11):3353-3360. Fifteen endoglucanase genes, two xylanase genes, and two β-glucosidase genes from *C. thermocellum* have been cloned and expressed in *E. coli*. Id. The wild type *C. thermocellum* (CelG) exhibits relatively low endoglucanase activity.

In some embodiments, endoglucanase polypeptides of the present invention exhibit improved properties as compared to CelGcat under conditions relevant to commercial saccharification and fermentation processes. Some of the EG polypeptides encompassed by the invention have amino acid substitutions in their sequences that result in enhanced thermostability, enhanced thermo-activity, and enhanced tolerance to low pHs compared to CelGcat (SEQ ID NO:2). These improvements make the invention endoglucanases potentially suitable for use in large scale saccharification processes. Endoglucanases of the present invention are suitable for catalyzing the hydrolysis of cellulose to generate fermentable sugars.

EG polypeptides of the present invention include isolated, recombinant and/or variant EG polypeptides comprising an amino acid sequence that is at least about 85% identical to CelGcat (SEQ ID NO: 2) and having at least one substitution selected from the group of V2, D3, D8, G14, Y18, M20, Y21, V25, S38, F42, A57, D58, I61, N62, I66, S90, H96, V97, D104, D109, M114, G122, N146, E148, K153, L173, D175, D180, A185, K204, L206, D214, T224, A226, E231, K235, V236, I238, V243, T254, D256, W270, K283, P286, I287, D288, L292, S294, I296, V297, M319, Y328, D329, I342, L343, H350, Q357, T361, L362, V368, Q369, R371, H373, L390, N392, E399, A403, K416, I418, K423, P425, K429, and/or L433, wherein the amino acid position is determined by alignment with SEQ ID NO: 2.

In some embodiments, the EG polypeptides of the present invention include isolated, recombinant and/or variant EG polypeptides comprising an amino acid sequence that is at least about 85% identical to CelGcat (SEQ ID NO: 2) and having at least one substitution selected from the group of V2/F/G/K/H/R, D3G, D8E, G14A, Y18V, M20K, Y21N, V25M, S38R, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, K283R, W270F/Y/I, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, and/or L433I, wherein amino acid position is determined by alignment with SEQ ID NO: 2.

Invention EG polypeptides may have an amino acid sequence that is at least about 86% identical to SEQ ID NO: 2 with one or more of the above-identified substitutions. Certain of these endoglucanase polypeptides may be at least about 87% identical, at least about 88% identical, at least about 89% identical, at least about 90% identical, at least about 91% identical, at least about 92% identical, at least about 93% identical, at least about 94% identical, at least about 95% identical, at least about 96% identical, at least about 97% identical, at least about 98% or at least about 99% identical to SEQ ID NO: 2 with one or more of the above-identified substitutions.

In some embodiments, the EG polypeptides of the present invention include isolated, recombinant and/or variant EG polypeptides comprising an amino acid sequence that is at least about 90% identical to CelGcat (SEQ ID NO: 2) and having at least one substitution selected from the group of Y18, I66, H96, D109, N146, E148, T224, K235, W270, V368, N392, K429, and/or L433, wherein amino acid position is determined by alignment with SEQ ID NO: 2. Certain of these EG polypeptides may be at least about 93% identical, at least about 94% identical, at least about 95% identical, at least about 96% identical, at least about 97% identical, at least about 98% or at least about 99% identical to SEQ ID NO: 2 with one or more of the above-identified substitutions.

In some embodiments, the EG polypeptides of the present invention include isolated, recombinant and/or variant EG polypeptides comprising an amino acid sequence that is at least about 90% identical to CelGcat (SEQ ID NO: 2) and having at least one substitution selected from the group of I66, H96, D109, E148, V368, and/or N392, wherein amino acid position is determined by alignment with SEQ ID NO: 2. Certain of these EG polypeptides may be at least about 93% identical, at least about 94% identical, at least about 95% identical, at least about 96% identical, at least about 97% identical, at least about 98% or at least about 99% identical to SEQ ID NO: 2 with one or more of the above-identified substitutions.

In some embodiments, the EG polypeptides of the present invention include isolated, recombinant and/or variant EG polypeptides comprising an amino acid sequence that is at least about 90% identical to CelGcat (SEQ ID NO: 2) and having at least one substitution selected from the group of Y18V, I66V, H96Y, D109G/S, N146I/E/M, E148P, T224K, K235N, W270F/Y/I, V368I, N392Y, K429I/N, and/or L433I, wherein amino acid position is determined by alignment with SEQ ID NO: 2.

In some embodiments, the EG polypeptides of the present invention include isolated, recombinant and/or variant EG polypeptides comprising an amino acid sequence that is at least about 95% identical to CelGcat (SEQ ID NO: 2) and having at least one substitution selected from the group of I66, H96, D109, E148, V368, and/or N392, wherein amino acid position is determined by alignment with SEQ ID NO: 2.

In some embodiments, the EG polypeptides of the present invention include isolated, recombinant and/or variant EG polypeptides comprising an amino acid sequence that is at least about 95% identical to CelGcat (SEQ ID NO: 2) and having at least one substitution selected from the group of I66V, H96Y, D109G/S, E148P, V368I, and/or N392Y, wherein amino acid position is determined by alignment with SEQ ID NO: 2.

In some embodiments, the EG polypeptide variants of the invention will include a an amino acid sequence having at least 90% sequence identity to SEQ ID NO: 2 and a substitution at positions I66 and D109 wherein the amino acid position is determined by alignment with SEQ ID NO: 2. In some embodiments, the EG polypeptide variant having a substitution at position 166 and D109 will have one, two, three, four, five, six, seven, eight, nine or ten further substitutions. In some embodiments, the further substitution is selected from positions Y18, H96, N146, E148, T224, E231, K235, W270, and/or K429. In some embodiments, the substitution at positions I66 is V and the substitution at position D109 is G or S.

In some embodiments of the invention, an isolated, recombinant and/or variant endoglucanase polypeptide comprises an amino acid sequence that is at least about 96%, at least about 97% identical, at least about 98% identical, at least about 99% identical to SEQ ID NO: 4.

In accordance with the present invention, in one embodiment, endoglucanase activity is determined using the assay of Example 7B.

Endoglucanase polypeptides of the present invention include those encoded by a nucleic acid that hybridizes under stringent conditions over substantially the entire length of a nucleic acid corresponding to a reference nucleic acid sequence selected from the group consisting of SEQ ID NO: 1, SEQ ID NO: 477 and the corresponding complementary sequence thereof, wherein the encoded polypeptide has an amino acid sequence comprising one or more substitutions selected from the group of V2, D3, D8, G14, Y18, M20, Y21, V25, S38, F42, A57, D58, I61, N62, I66, S90, H96, V97, D104, D109, M114, G122, N146, E148, K153, L173, D175, D180, A185, K204, L206, D214, T224, A226, E231, K235, V236, I238, V243, T254, D256, W270, K283, P286, I287, D288, L292, S294, I296, V297, M319, Y328, D329, I342, L343, H350, Q357, T361, L362, V368, Q369, R371, H373, L390, N392, E399, A403, K416, I418, K423, P425, K429, and/or L433, wherein the amino acid position is determined by alignment with SEQ ID NO: 2.

In other embodiments, EG polypeptides of the present invention include those encoded by a nucleic acid that hybridizes under stringent conditions over substantially the entire length of a nucleic acid corresponding to a reference nucleic acid sequence selected from the group consisting of SEQ ID NO: 1, SEQ ID NO: 477 and the corresponding complementary sequence thereof, wherein the encoded polypeptide has an amino acid sequence comprising one or more substitutions selected from the group of V2F/G/K/H/R, D3G, D8E, G14A, Y18V, M20K, Y21N, V25M, S38R, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, W270F/Y/I, K283R, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, and/or L433I, wherein amino acid position is determined by alignment of the encoded amino acid sequence with SEQ ID NO: 2.

Significantly, endoglucanase polypeptides of the present invention include those having improved (i.e., greater) endoglucanase activity relative to CelGcat (SEQ ID NO: 2), as measured in the assay described in Example 7B, For example, endoglucanase polypeptides of the present invention may have endoglucanase activity that is at least about 1.0-fold, at least about 1.5-fold, at least about 2-fold, at least about 3-fold, at least about 4-fold, at least about 5-fold, at least about 6-fold, at least about 7-fold, at least about 8-fold, and at least about 9-fold greater than the endoglucanase activity of wild type *Clostridium thermocellum* endoglucanase (CelGcat) (SEQ ID NO: 2), as measured in the assay described in Example 7B.

The present invention further provides an isolated, recombinant or variant endoglucanase polypeptide having an amino acid sequence that has a substitution, deletion, and/or insertion of from one to twenty amino acid residues in a sequence selected from the group consisting of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, and 476, wherein the polypeptide exhibits at least about 1.5-fold greater endoglucanase activity than wild type *Clostridium thermocellum* endoglucanase (CelGcat) (SEQ ID NO: 2), as measured in the assay of Example 7B (where the endoglucanase polypeptide is not the wild type *Clostridium thermocellum* endoglucanase).

These endoglucanase polypeptides may have a substitution, deletion, and/or insertion of from one to two, or from one or two, to three, four, five, six, seven, eight, nine, ten, eleven, twelve, thirteen, fourteen, fifteen, sixteen, seventeen, eighteen, nineteen, and up to twenty residues. Typically, these endoglucanases exhibit endoglucanase activity that is at least about 1.5-fold, at least about 2 fold, at least about 3 fold, at least about 4-fold, at least about 5-fold, at least about 6-fold-, at least about 7-fold, at least about 8-fold, and up to about 9-fold, greater as compared to wild type *Clostridium thermocellum* endoglucanase (CelGcat) (SEQ ID NO: 2), as measured in the assay described in Example 7B. In some embodiments, the isolated, recombinant or variant endoglucanase polypeptides of the invention will comprise a substitution of from one to five amino acid residues in a sequence selected from the group of SEQ ID NOs: listed above.

Sequence-activity analyses indicated that certain of the above-described mutations/substitutions appeared particularly favorable with respect to increasing endoglucanase activity relative to CelGcat (SEQ ID NO: 2). Sequence-activity analysis was performed in accordance with the methods described in WO 03/075129, U.S. Ser. No. 10/379,378 filed Mar. 3, 2003, and R. Fox et al., "Optimizing the search algorithm for protein engineering by directed evolution," *Protein Eng.* 16(8):589-597 (2003), both of which are incorporated herein by reference. See also R. Fox et al., "Directed molecular evolution by machine learning and the influence of non-linear interactions," *J. Theor. Biol.* 234(2):187-199 (2005), which is incorporated herein by reference. This analysis indicated that the following substitutions appeared particularly beneficial with respect to endoglucanase activity in connection with the endoglucanase polypeptides described herein: I66V, E231A, E148P, D109G, E231A, I342L, and N392Y, wherein amino acid position is determined by alignment of the encoded amino acid sequence with SEQ ID NO: 2. Thus, the present invention provides an isolated, recombinant or variant endoglucanase polypeptide having the features of any one of the endoglucanase polypeptide embodiments described herein, wherein the amino acid sequence of the endoglucanase polypeptide further comprises a substitution selected from the group consisting of I66V, E231A, E148P, D109G, E231A, I342L, and N392Y, wherein amino acid position is determined by optimal alignment with SEQ ID NO: 2.

In another embodiment, the present invention also provides a fragment of the endoglucanase polypeptides described herein having endoglucanase activity as detected in the assay of Example 7B. These fragments are referred to herein as "endoglucanase fragments". As used herein, the term "fragment" refers to a polypeptide having a deletion of from 1 to 15 amino acid residues from the carboxy terminus, the amino terminus, or both. In certain embodiments, the deletion is from 1 to 14 residues from the carboxy terminus, the amino terminus, or both. In some embodiments, the deletion may be from 1 to 10 residues, or 1 to 5 residues from the carboxy terminus, the amino terminus, or both. Endoglucanase fragments of the present invention include those that have at least about 1.5-fold, at least about 2-fold, at least about 3-fold, at least about 4-fold, at least about 5-fold-, at least about 6-fold, at least about 7-fold, and at least about 8-fold greater endoglucanase activity as compared to CelGcat (SEQ ID NO: 2), as measured in the assay described in Example 7B.

The amino acid sequences of the endoglucanase polypeptides described herein may have any combination of 2 or more substitutions, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, 23 or more, 24 or more, 25 or more, 26 or more, 27 or more, 28 or more, 29 or more, 30 or more, 31 or more, 32 or more, 33 or more, 34 or more, 35 or more, 36 or more, 37 or more, 38 or more, 39 or more, 40 or more, 41 or more, 42 or more, 43 or more, 44 or more, 45 or more, 46 or more, 47 or more, 48 or more, 49 or more, 50 or more, 51 or more, 52 or more, 53 or more, 54 or more, 55 or more, 56 or more, 57 or more, 58 or more, 59 or more, 60 or more, 61 or more, 62 or more, 63 or more, 64 or more, 65 or more, 66 or more, 67 or more, 68 or more, 69 or more, 70 or more, 71 or more, 72 or more, 73 or more, or 74 substitutions (one substitution per position) selected from the following: V2/F/G/K/H/R, D3G, D8E, G14A, Y18V, M20K, Y21N, V25M, S38R, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, W270Y, K283R, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, and/or L433I, wherein amino acid position is determined by alignment with SEQ ID NO: 2 and wherein only one substitution is selected per position.

The present invention includes conservatively modified variants of the endoglucanase polypeptides described herein. These variants have conservative substitutions made in their amino acid sequences. Examples of conservative substitutions are within the group of basic amino acids (arginine, lysine and histidine), acidic amino acids (glutamic acid and aspartic acid), polar amino acids (glutamine and asparagines), hydrophobic amino acids (leucine, isoleucine and valine), aromatic amino acids (phenylalanine, tryptophan and tyrosine), and small amino acids (glycine, alanine, serine, threonine, proline, cysteine and methionine).

Conservatively substituted variations of the endoglucanase polypeptides of the present invention include substitutions of a small percentage, typically less than 5%, more typically less than 2%, and often less than 1% of the amino acids of the polypeptide sequence, with a conservatively selected amino acid of the same conservative substitution group. The addition of sequences which do not alter the encoded activity of an endoglucanase polynucleotide, such as the addition of a non-functional or non-coding sequence, is considered a conservative variation of the endoglucanase polynucleotide. The amino acid and polynucleotide sequences of endoglucanase polypeptides not specifically described herein can be readily generated and identified using methods that are well known to those having ordinary skill in the art. Libraries of these endoglucanase polypeptides may be generated and then screened using the high throughput screen for presence of endoglucanase activity described in Example 7B.

Methods for generating variant libraries are well known in the art. For example, mutagenesis and directed evolution methods can be readily applied to polynucleotides (such as, for example, native *Clostridium thermocellum* endoglucanase encoding polynucleotides (e.g., SEQ ID NO: 1) or the polynucleotides of the present invention (described hereinbelow)) to generate variant libraries that can be expressed, screened, and assayed using the methods described herein. Mutagenesis and directed evolution methods are well known in the art. See, e.g., Ling, et al., "Approaches to DNA mutagenesis: an overview," *Anal. Biochem.*, 254(2):157-78 (1997); Dale, et al., "Oligonucleotide-directed random mutagenesis using the phosphorothioate method," *Methods Mol. Biol.*, 57:369-74 (1996); Smith, "In vitro mutagenesis," *Ann. Rev. Genet.*, 19:423-462 (1985); Botstein, et al., "Strategies and applications of in vitro mutagenesis," *Science*, 229:1193-1201 (1985); Carter, "Site-directed mutagenesis," *Biochem. J.*, 237:1-7 (1986); Kramer, et al., "Point Mismatch Repair," *Cell*, 38:879-887 (1984); Wells, et al., "Cassette mutagenesis: an efficient method for generation of multiple mutations at defined sites," *Gene*, 34:315-323 (1985); Minshull, et al., "Protein evolution by molecular breeding," *Current Opinion in Chemical Biology*, 3:284-290 (1999); Christians, et al., "Directed evolution of thymidine kinase for AZT phosphorylation using DNA family shuffling," *Nature Biotechnology*, 17:259-264 (1999); Crameri, et al., "DNA shuffling of a family of genes from diverse species accelerates directed evolution," *Nature*, 391:288-291; Crameri, et al., "Molecular evolution of an arsenate detoxification pathway by DNA shuffling," *Nature Biotechnology*, 15:436-438 (1997); Zhang, et al., "Directed evolution of an effective fucosidase from a galactosidase by DNA shuffling and screening," *Proceedings of the National Academy of Sciences, U.S.A.*, 94:45-4-4509; Crameri, et al., "Improved green fluorescent protein by molecular evolution using DNA shuffling," *Nature Biotechnology*, 14:315-319 (1996); Stemmer, "Rapid evolution of a protein in vitro by DNA shuffling," *Nature*, 370:389-391 (1994); Stemmer, "DNA shuffling by random fragmentation and reassembly: In vitro recombination for molecular evolution," *Proceedings of the National Academy of Sciences, U.S.A.*, 91:10747-10751 (1994); WO 95/22625; WO 97/0078; WO 97/35966; WO 98/27230; WO 00/42651; and WO 01/75767, all of which are incorporated herein by reference.

Exemplary endoglucanase polypeptides of the invention include those corresponding to SEQ ID NOs: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, and 476.

Most native cellulases are multidomain structures which comprise a catalytic domain, linker domain and cellulose binding domain (CBD) (Suumakki et al., Cellulose 7:189-209 (2004). The catalytic domain (also referred to as the core domain) includes the active site. The CBD interacts with a cellulose substrate by binding to the substrate. CBD may be particularly important in the hydrolysis of crystalline cellulose. Therefore in some embodiments, the isolated, recombinant and/or variant EGs of the invention comprise an amino acid sequence that is at least about 85% identical to the EG of amino acid sequence of native EG (SEQ ID NO: 478) and having a substitution selected from the group of V2, D3, D8, G14, Y18, M20, Y21, V25, S38, F42, A57, D58, I61, N62, I66, S90, H96, V97, D104, D109, M114, G122, N146, E148, K153, L173, D175, D180, A185, K204, L206, D214, T224, A226, E231, K235, V236, I238, V243, T254, D256, W270, K283, P286, I287, D288, L292, S294, I296, V297, M319, Y328, D329, I342, L343, H350, Q357, T361, L362, V368, Q369, R371, H373, L390, N392, E399, A403, K416, I418, K423, P425, K429, L433 and/or G444, wherein the amino acid position is determined by alignment with SEQ ID NO: 478.

In further embodiments, the EG polypeptides of the present invention include isolated, recombinant and/or variant EG polypeptides comprising an amino acid sequence that is at least about 85% identical (also at least about 90%, at least about 93%, at least about 95%, at least about 97%, at least about 98% identical) to native CelG (SEQ ID NO: 478) and having at least one substitution selected from the group of V2/F/G/K/H/R, D3G, D8E, G14A, Y18V, M20K, Y21N, V25M, S38R, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, K283R, W270F/Y/I, P286L, I287F/T, D288N, L292P, S294L/M, I296V, V297L, M319K/V, Y328D/R, D329V, I342L, L343Q, H350L, Q357F, T361M, L362I, V368I, Q369E, R371C, H373L/Q, L390F, N392Y, E399D, A403V, K416R, I418V, K423N, P425H, K429I/N, L433I and/or G444C, wherein amino acid position is determined by alignment with SEQ ID NO: 478.

Endoglucanase Polynucleotides:

The present invention provides isolated or recombinant polynucleotides that encode any of the above-described endoglucanase polypeptides.

Those having ordinary skill in the art will readily appreciate that due to the degeneracy of the genetic code, a multitude of nucleotide sequences encoding endoglucanase polypeptides of the present invention exist. Table 1 is a Codon Table that provides the synonymous codons for each amino acid. For example, the codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that U in an RNA sequence corresponds to T in a DNA sequence.

TABLE 1

Codon Table

| Amino acids | | Codon |
|---|---|---|
| Alanine | Ala A | GCA GCC GCG GCU |
| Cysteine | Cys C | UGC UGU |
| Aspartic acid | Asp D | GAC GAU |
| Glutamic acid | Glu E | GAA GAG |
| Phenylalanine | Phe F | UUC UUU |
| Glycine | Gly G | GGA GGC GGG GGU |
| Histidine | His H | CAC CAU |
| Isoleucine | Ile I | AUA AUC AUU |
| Lysine | Lys K | AAA AAG |
| Leucine | Leu L | UUA UUG CUA CUC CUG CUU |
| Methionine | Met M | AUG |
| Asparagine | Asn N | AAC AAU |
| Proline | Pro P | CCA CCC CCG CCU |
| Glutamine | Gln Q | CAA CAG |
| Arginine | Arg R | AGA AGG CGA CGC CGG CGU |
| Serine | Ser S | AGC AGU UCA UCC UCG UCU |
| Threonine | Thr T | ACA ACC ACG ACU |
| Valine | Val V | GUA GUC GUG GUU |
| Tryptophan | Trp W | UGG |
| Tyrosine | Tyr Y | UAC UAU |

Such "silent variations" are one species of "conservative" variation. One of ordinary skill in the art will recognize that each codon in a nucleic acid (except AUG, which is ordinarily the only codon for methionine) can be modified by standard techniques to encode a functionally identical polypeptide. Accordingly, each silent variation of a nucleic acid which encodes a polypeptide is implicit in any described sequence. The invention contemplates and provides each and every possible variation of nucleic acid sequence encoding a polypeptide of the invention that could be made by selecting combinations based on possible codon choices. These combinations are made in accordance with the standard triplet genetic code (set forth in Table 1), as applied to the polynucleotide sequences of the present invention.

A group of two or more different codons that, when translated in the same context, all encode the same amino acid, are referred to herein as "synonymous codons." Endoglucanase polynucleotides of the present invention may be codon optimized for expression in a particular host organism by modifying the polynucleotides to conform with the optimum codon usage of the desired host organism. Those having ordinary skill in the art will recognize that tables and other references providing preference information for a wide range of organisms are readily available See e.g., Henaut and Danchin in "*Escherichia coli* and *Salmonella*," Neidhardt, et al. Eds., ASM Pres, Washington D.C. (1996), pp. 2047-2066, which is incorporated herein by reference.

The terms "conservatively modified variations" and "conservative variations" are used interchangeably herein to refer to those nucleic acids that encode identical or essentially identical amino acid sequences, or in the situation where the nucleic acids are not coding sequences, the term refers to nucleic acids that are identical. One of ordinary skill in the art will recognize that individual substitutions, deletions or additions which alter, add or delete a single amino acid or a small percentage of amino acids in an encoded sequence are considered conservatively modified variations where the alterations result in one or more of the following: the deletion of an amino acid, addition of an amino acid, or substitution of an amino acid with a chemically similar amino acid. When more than one amino acid is affected, the percentage is typically less than 5% of amino acid residues over the length of the encoded sequence, more typically less than 2% and even more typically often less than 1% of the amino acids of the polypeptide sequence. References providing amino acids that are considered conservative substitutions for one another are well known in the art. In some embodiments, the number of conservative amino acids replacements will be 1, 2, 3, 4, 5, 6, 7, 8, 9, 10, 12, 14, 16, 18, 20, or 22 amino acid residues.

An exemplary endoglucanase polynucleotide that has been codon optimized for expression in *E. coli* is provided as SEQ ID NO: 1 which is a variant of the wild type polynucleotide encoding *Clostridium thermocellum* endoglucanase (SEQ ID NO: 2). Specific codons have been identified in polynucleotides of the present invention which differ from the corresponding wild type *Clostridium thermocellum* codon. The present invention further provides an isolated or recombinant endoglucanase polynucleotide having a polynucleotide sequence comprising one or more substitutions selected from the group consisting of c36t, g66a, g189a, g201a, g210t, c324t, c405t, g432a, c445t, t507a, c552t, t606c, g615t, c633t, c639t, c855t, g858a, t865c, t924c, g927a, g1059a, t1068c, c1104t, g1107a, a1167g, t1185c, g1224a, c1254a, a1257t, and g1284c (where nucleotide position is determined by optimal alignment with SEQ ID NO: 1). Endoglucanase polypeptides of the present invention that are encoded by these silent mutations are identified in Table 2 hereinbelow.

Polynucleotides of the present invention can be prepared using methods that are well known in the art. Typically, oligonucleotides of up to about 120 bases are individually synthesized, then joined (e.g., by enzymatic or chemical ligation methods, or polymerase-mediated methods) to form essentially any desired continuous sequence. For example, polynucleotides of the present invention can be prepared by chemical synthesis using, for example, the classical phosphoramidite method described by Beaucage, et al. (1981) *Tetrahedron Letters,* 22:1859-69, or the method described by Matthes, et al. (1984) *EMBO J.,* 3:801-05, both of which are incorporated herein by reference. These methods are typically practiced in automated synthetic methods. According to the phosphoramidite method, oligonucleotides are synthesized, e.g., in an automatic DNA synthesizer, purified, annealed, ligated and cloned in appropriate vectors.

In addition, essentially any nucleic acid can be custom ordered from any of a variety of commercial sources, such as The Midland Certified Reagent Company (Midland, Tex.), The Great American Gene Company (Ramona, Calif.), ExpressGen Inc. (Chicago, Ill.), Operon Technologies Inc. (Alameda, Calif.), and many others.

Polynucleotides may also be synthesized by well-known techniques as described in the technical literature. See, e.g., Carruthers, et al., *Cold Spring Harbor Symp. Quant. Biol.*, 47:411-418 (1982) and Adams, et al., *J. Am. Chem. Soc.*, 105:661 (1983), both of which are incorporated herein by reference. Double stranded DNA fragments may then be obtained either by synthesizing the complementary strand and annealing the strands together under appropriate conditions, or by adding the complementary strand using DNA polymerase with an appropriate primer sequence.

General texts which describe molecular biological techniques useful herein, including the use of vectors, promoters and many other relevant topics, include Berger and Kimmel, *Guide to Molecular Cloning Techniques, Methods in Enzymology* volume 152 Academic Press, Inc., San Diego, Calif. (Berger); Sambrook et al., *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in Molecular Biology*, F. M. Ausubel et al., eds., Current Protocols, a joint venture between Greene Publishing Associates, Inc. and John Wiley & Sons, Inc., (supplemented through 1999) ("Ausubel"), all of which are incorporated herein by reference. Examples of protocols sufficient to direct persons of skill through in vitro amplification methods, including the polymerase chain reaction (PCR) the ligase chain reaction (LCR), Qβ-replicase amplification and other RNA polymerase mediated techniques (e.g., NASBA), e.g., for the production of the homologous nucleic acids of the invention are found in Berger, Sambrook, and Ausubel, as well as Mullis et al., (1987) U.S. Pat. No. 4,683,202; *PCR Protocols A Guide to Methods and Applications* (Innis et al. eds) Academic Press Inc. San Diego, Calif. (1990) (Innis); Arnheim & Levinson (Oct. 1, 1990) C&EN 36-47; *The Journal Of NIH Research* (1991) 3, 81-94; (Kwoh et al. (1989) *Proc. Natl. Acad. Sci. USA* 86, 1173; Guatelli et al. (1990) *Proc. Natl. Acad. Sci. USA* 87, 1874; Lomell et al. (1989) *J. Clin. Chem.* 35, 1826; Landegren et al., (1988) *Science* 241, 1077-1080; Van Brunt (1990) *Biotechnology* 8, 291-294; Wu and Wallace, (1989) *Gene* 4, 560; Barringer et al. (1990) *Gene* 89, 117, and Sooknanan and Malek (1995) *Biotechnology* 13: 563-564, all of which are incorporated herein by reference.

Improved methods for cloning in vitro amplified nucleic acids are described in Wallace et al., U.S. Pat. No. 5,426,039, which is incorporated herein by reference Improved methods for amplifying large nucleic acids by PCR are summarized in Cheng et al. (1994) *Nature* 369: 684-685, which is incorporated herein by reference, and the references cited therein, in which PCR amplicons of up to 40 kb are generated. One of ordinary skill in the art will readily appreciate that essentially any RNA can be converted into a double stranded DNA suitable for restriction digestion, PCR expansion and sequencing using reverse transcriptase and a polymerase. See, e.g., Ausubel, Sambrook and Berger, all supra, which are incorporated herein by reference.

Exemplary endoglucanase polynucleotides of the present invention include those corresponding to SEQ ID NOs: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, and 475. Each of these polynucleotides encode a polypeptide having the subsequent even number sequence identifier, for example the polynucleotide having SEQ ID NO: 17 encodes the variant endoglucanase having SEQ ID NO: 18 and the polynucleotide having SEQ ID NO: 121 encodes an endoglucanase variant having SEQ ID NO: 122.

Vectors, Promoters, and Expression Systems:

The present invention also includes recombinant constructs and vectors comprising one or more of the endoglucanase polynucleotide sequences as broadly described above. In some embodiments, the DNA construct or nucleic acid construct comprising an endoglucanase polynucleotide of the present invention is operably linked to a promoter. Example 1 provides a description of how to make constructs for expression of endoglucanase polypeptides. However, one skilled in the art is aware of means for making DNA constructs. The term "control sequences" refers herein to all the components that are necessary or advantageous for the expression of a polypeptide of the present invention. Each control sequence may be native or foreign to the nucleotide sequence encoding the polypeptide. Such control sequences include, but are not limited to, a leader, promoter, signal peptide sequence, and transcription terminator. At a minimum, the control sequences include a promoter and transcriptional and translational stop signals. In some embodiments, the control sequence may include a polyadenylation sequence. The control sequences may be provided with linkers for the purpose of introducing specific restriction sites facilitating ligation of the control sequences with the coding region of the nucleotide sequence encoding a polypeptide.

Nucleic acid constructs of the present invention comprise a vector, such as, a plasmid, a cosmid, a phage, a virus, a bacterial artificial chromosome (BAC), a yeast artificial chromosome (YAC), or the like, into which a nucleic acid sequence of the invention has been inserted, in a forward or reverse orientation. Large numbers of suitable vectors and promoters are known to those of skill in the art, and are commercially available.

Polynucleotides of the present invention can be incorporated into any one of a variety of expression vectors suitable for expressing a polypeptide. Suitable vectors include chromosomal, nonchromosomal and synthetic DNA sequences, e.g., derivatives of SV40; bacterial plasmids; phage DNA; baculovirus; yeast plasmids; vectors derived from combinations of plasmids and phage DNA, viral DNA such as vaccinia, adenovirus, fowl pox virus, pseudorabies, adenovirus, adeno-associated virus, retroviruses and many others. Any vector that transduces genetic material into a cell, and, if replication is desired, which is replicable and viable in the relevant host can be used.

When incorporated into an expression vector, a polynucleotide of the invention is operatively linked to an appropriate transcription control sequence (promoter) to direct mRNA synthesis, e.g., T5 promoter. Examples of such transcription control sequences particularly suited for use in transgenic plants include the cauliflower mosaic virus (CaMV) and figwort mosaic virus (FMV). Other promoters known to control expression of genes in prokaryotic or eukaryotic cells or their viruses and which can be used in some embodiments of the invention include SV40 promoter, *E. coli* lac or trp promoter, phage lambda $P_L$ promoter, tac promoter, T7 promoter, and the like. Examples of suitable promoters useful for directing the transcription of the nucleotide constructs of the present invention in a filamentous fungal host cell are promoters such as cbh1, cbh2, egl1, egl2, pepA, hfb1, hfb2, xyn1, amy, and glaA (Nunberg et al., Mol. Cell. Biol., 4:2306-2315 (1984), Boel et al., EMBO J 3:1581-1585 ((1984) and EPA 137280). In bacterial host cells, suitable promoters include the promoters obtained from the *E. coli* lac operon, *Streptomyces coelicolor* agarase gene (dagA), *Bacillus subtilis* levansucranse gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus subtilis* xylA and xylB genes and prokaryotic beta-lactamase gene. An expression vector optionally contains a ribosome binding site for translation initiation, and a transcription terminator, such as PinII. The vector also optionally includes appropriate sequences for amplifying expression, e.g., an enhancer.

The vector or DNA construct may also generally include a signal peptide coding region that codes for an amino acid sequence linked to the amino terminus of a polypeptide and which directs the encoded polypeptide into the cells secretory pathway. Effective signal peptide coding regions for bacterial host cells may be obtained from the genes of Bacillus NCIB 11837 maltogenic amylase, *B. stearothermophilus* alpha-amylase, *B. licheniformis* subtilisin, *B. licheniformis* beta-lactamase, *B. stearothermophilus* neutral proteases (nprT, nprS, nprM) and *B. subtilis* prsS. Further signal sequences are described in Simonen and Palva (1993), Microbiological Reviews 57:109-137. Effective signal peptides coding regions for filamentous fungal host cells include but are not limited to the signal peptide coding regions obtained from *Aspergillus oryzae* TAKA amylase, *Aspergillus niger* neutral amylase, *Aspergillus niger* glucoamylase, *Rhizomucor miehei* aspartic proteinase, *Humicola insolens* cellulase and *Humicola lanuginosa* lipase.

In addition, the expression vectors of the present invention optionally contain one or more selectable marker genes to provide a phenotypic trait for selection of transformed host cells. Suitable marker genes include those coding for antibiotic resistance such as, ampicillin, kanamycin, chloramphenicol, or tetracycline resistance. Further examples include the antibiotic spectinomycin or streptomycin (e.g., the aada gene), the streptomycin phosphotransferase (SPT) gene coding for streptomycin resistance, the neomycin phosphotransferase (NPTII) gene encoding kanamycin or geneticin resistance, the hygromycin phosphotransferase (HPT) gene coding for hygromycin resistance. Additional selectable marker genes include dihydrofolate reductase or neomycin resistance for eukaryotic cell culture, and tetracycline or ampicillin resistance in *E. coli*.

An exemplary expression vector for the expression of an endoglucanase polypeptide of the present invention is depicted in FIG. 1. Vectors of the present invention can be employed to transform an appropriate host to permit the host to express an invention protein or polypeptide.

Endoglucanase polynucleotides of the invention can also be fused, for example, in-frame to nucleic acids encoding a secretion/localization sequence, to target polypeptide expression to a desired cellular compartment, membrane, or organelle of a cell, or to direct polypeptide secretion to the periplasmic space or into the cell culture media. Such sequences are known to those of skill, and include secretion leader peptides, organelle targeting sequences (e.g., nuclear localization sequences, endoplasmic reticulum (ER) retention signals, mitochondrial transit sequences, peroxisomal transit sequences, and chloroplast transit sequences), membrane localization/anchor sequences (e.g., stop transfer sequences, GPI anchor sequences), and the like.

Expression Hosts:

The present invention also relates to engineered (recombinant) host cells that are transformed with a vector or DNA construct of the invention (e.g., an invention cloning vector or an invention expression vector), as well as the production of polypeptides of the invention. Thus, the present invention is directed to a host cell comprising any polynucleotide of the present invention that is described hereinabove. As used herein a genetically modified or recombinant host cell includes the progeny of said host cell that comprises an endoglucanase polynucleotide encompassed by the invention and which encodes a recombinant or variant endoglucanase polypeptide of the invention.

In some embodiments, the genetically modified or recombinant host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. Particularly preferred fungal host cells are yeast cells and filamentous fungal cells. The filamentous fungi host cells of the present invention include all filamentous forms of the subdivision Eumycotina and Oomycota. (Hawksworth et al., In Ainsworth and Bisby's Dictionary of The Fungi, 8$^{th}$ edition, 1995, CAB International, University Press, Cambridge, UK). Filamentous fungi are characterized by a vegetative mycelium with a cell wall composed of chitin, cellulose and other complex polysaccharides. The filamentous fungi host cells of the present invention are morphologically distinct from yeast.

In the present invention, a filamentous fungal host cell may be a cell of a species of, but not limited to *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Trametes, Tolypocladium, Trichoderma, Verticillium, Volvariella*, or teleomorphs, or anamorphs, and synonyms or taxonomic equivalents thereof.

In some embodiments of the invention, the filamentous fungal host cell is of the, *Aspergillus* species, *Ceriporiopsis* species, *Chrysosporium* species, *Corynascus* species, *Fusarium* species, *Humicola* species, *Myceliophthora* species, *Neurospora* species, *Penicillium* species, *Tolypocladium* species, *Tramates* species, or *Trichoderma* species or teleomorphs, or anamorphs, and synonyms or taxonomic equivalents thereof.

In some embodiments of the invention, the filamentous fungal host cell is of the *Trichoderma* species, e.g., *T. longibrachiatum*, *T. viride* (e.g., ATCC 32098 and 32086), *Hypocrea jecorina* or *T. reesei* (NRRL 15709, ATTC 13631, 56764, 56765, 56466, 56767 and RL-P37 and derivatives thereof—See Sheir-Neiss et al., Appl. Microbiol. Biotechnology, 20 (1984) pp 46-53), *T. koningii*, and *T. harzianum*. In addition, the term "*Trichoderma*" refers to any fungal strain that was previously classified as *Trichoderma* or currently classified as *Trichoderma*. In some embodiments of the invention, the filamentous fungal host cell is of the *Aspergillus* species, e.g., *A. awamori*, *A. funigatus*, *A. japonicus*, *A. nidulans*, *A. niger*, *A. aculeatus*, *A. foetidus*, *A. oryzae*, *A. sojae*, and *A. kawachi*. (Reference is made to Kelly and Hynes (1985) EMBO J. 4, 475479; NRRL 3112, ATCC 11490, 22342, 44733, and 14331; Yelton M., et al., (1984) Proc. Natl. Acad. Sci. USA, 81, 1470-1474; Tilburn et al., (1982) Gene 26, 205-221; and Johnston, I. L. et al. (1985) EMBO J. 4, 1307-1311). In some embodiments of the invention, the filamentous fungal host cell is of the *Chrysosporium* species, e.g., *C. lucknowense*, *C. keratinophilum*, *C. tropicum*, *C. merdarium*, *C. inops*, *C. pannicola*, and *C. zonatum*. In some embodiments of the invention, the filamentous fungal host cell is of the *Fusarium* species, e.g., *F. bactridioides*, *F. cerealis*, *F. crookwellense*, *F. culmorum*, *F. graminearum*, *F. graminum*. *F. oxysporum*, *F. roseum*, and *F. venenatum*. In some embodiments of the invention, the filamentous fungal host cell is of the *Neurospora* species, e.g., *N. crassa*. Reference is made to Case, M. E. et al., (1979) *Proc. Natl. Acad. Sci.* USA, 76, 5259-5263; U.S. Pat. No. 4,486,553; and Kinsey, J. A. and J. A. Rambosek (1984) *Molecular and Cellular Biology* 4, 117-122. In some embodiments of the invention, the filamentous fungal host cell is of the *Humicola* species, e.g., *H. insolens*, *H. grisea*, and *H. lanuginosa*. In some embodiments of the invention, the filamentous fungal host cell is of the *Mucor* species, e.g., *M. miehei* and *M. circinelloides*. In some embodiments of the invention, the filamentous fungal host cell is of the *Myceliophthora* species, e.g., *M. thermophila*. In some embodiments of the invention, the filamentous fungal host cell is of the *Rhizopus* species, e.g., *R. oryzae* and *R. niveus*. In some embodiments of the invention, the filamentous fungal host cell is of the *Penicillum* species, e.g., *P. purpurogenum*, *P. chrysogenum*, and *P. verruculosum*. In some embodiments of the invention, the filamentous fungal host cell is of the *Thielavia* species, e.g., *T. terrestris*. In some embodiments of the invention, the filamentous fungal host cell is of the *Tolypocladium* species, e.g., *T. inflatum* and *T. geodes*. In some embodiments of the invention, the filamentous fungal host cell is of the *Trametes* species, e.g., *T. villosa* and *T. versicolor*.

In the present invention a yeast host cell may be a cell of a species of, but not limited to *Candida*, *Hansenula*, *Saccharomyces*, *Schizosaccharomyces*, *Pichia*, *Kluyveromyces*, and *Yarrowia*. In some embodiments of the invention, the yeast cell is *Hansenula polymorpha*, *Saccharomyces cerevisiae*, *Saccaromyces carlsbergensis*, *Saccharomyces diastaticus*, *Saccharomyces norbensis*, *Saccharomyces kluyveri*, *Schizosaccharomyces pombe*, *Pichia pastoris*, *Pichia finlandica*, *Pichia trehalophila*, *Pichia kodamae*, *Pichia membranaefaciens*, *Pichia opuntiae*, *Pichia thermotolerans*, *Pichia salictaria*, *Pichia quercuum*, *Pichia pijperi*, *Pichia stipitis*, *Pichia methanolica*, *Pichia angusta*, *Kluyveromyces lactis*, *Candida albicans*, and *Yarrowia lipolytica*.

In some embodiments on the invention, the host cell is an algal such as, *Chlamydomonas* (e.g., *C. Reinhardtii*) and *Phormidium* (P. sp. ATCC29409).

In other embodiments, the host cell is a prokaryotic cell. Suitable prokaryotic cells include gram positive, gram negative and gram-variable bacterial cells. The host cell may be a species of, but not limited to *Agrobacterium*, *Alicyclobacillus*, *Anabaena*, *Anacystis*, *Acinetobacter*, *Acidothermus*, *Arthrobacter*, *Azobacter*, *Bacillus*, *Bifidobacterium*, *Brevibacterium*, *Butyrivibrio*, *Buchnera*, *Campestris*, *Camplyobacter*, *Clostridium*, *Corynebacterium*, *Chromatium*, *Coprococcus*, *Escherichia*, *Enterococcus*, *Enterobacter*, *Erwinia*, *Fusobacterium*, *Faecalibacterium*, *Francisella*, *Flavobacterium*, *Geobacillus*, *Haemophilus*, *Helicobacter*, *Klebsiella*, *Lactobacillus*, *Lactococcus*, *Ilyobacter*, *Micrococcus*, *Microbacterium*, *Mesorhizobium*, *Methylobacterium*, *Methylobacterium*, *Mycobacterium*, *Neisseria*, *Pantoea*, *Pseudomonas*, *Prochlorococcus*, *Rhodobacter*, *Rhodopseudomonas*, *Rhodopseudomonas*, *Roseburia*, *Rhodospirillum*, *Rhodococcus*, *Scenedesmus*, *Streptomyces*, *Streptococcus*, *Synecoccus*, *Saccharomonospora*, *Staphylococcus*, *Serratia*, *Salmonella*, *Shigella*, *Thermoanaerobacterium*, *Tropheryma*, *Tularensis*, *Temecula*, *Thermosynechococcus*, *Thermococcus*, *Ureaplasma*, *Xanthomonas*, *Xylella*, *Yersinia* and *Zymomonas*. In some embodiments, the host cell is a species of *Agrobacterium*, *Acinetobacter*, *Azobacter*, *Bacillus*, *Bifidobacterium*, *Buchnera*, *Geobacillus*, *Campylobacter*, *Clostridium*, *Corynebacterium*, *Escherichia*, *Enterococcus*, *Erwinia*, *Flavobacterium*, *Lactobacillus*, *Lactococcus*, *Pantoea*, *Pseudomonas*, *Staphylococcus*, *Salmonella*, *Streptococcus*, *Streptomyces*, and *Zymomonas*. In yet other embodiments, the bacterial host strain is non-pathogenic to humans. In some embodiments the bacterial host strain is an industrial strain. Numerous bacterial industrial strains are known and suitable in the present invention.

In some embodiments of the invention, the bacterial host cell is of the *Agrobacterium* species, e.g., *A. radiobacter*, *A. rhizogenes*, and *A. rubi*. In some embodiments of the invention the bacterial host cell is of the *Arthrobacter* species, e.g., *A. aurescens*, *A. citreus*, *A. globformis*, *A. hydrocarboglutamicus*, *A. mysorens*, *A. nicotianae*, *A. paraffineus*, *A. protophonniae*, *A. roseoparqffinus*, *A. sulfureus*, and *A. ureafaciens*. In some embodiments of the invention the bacterial host cell is of the *Bacillus* species, e.g., *B. thuringiensis*, *B. anthracia*, *B. megaterium*, *B. subtilis*, *B. lentus*, *B. circulans*, *B. pumilus*, *B. lautus*, *B. coagulans*, *B. brevis*, *B. firmus*, *B. alkaophius*, *B. licheniformis*, *B. clausii*, *B. stearothermophilus*, *B. halodurans* and *B. amyloliquefaciens*. In particular embodiments, the host cell will be an industrial *Bacillus* strain including but not limited to *B. subtilis*, *B. pumilus*, *B. licheniformis*, *B. megaterium*, *B. clausii*, *B. stearothermophilus* and *B. amyloliquefaciens*. Some preferred embodiments of a *Bacillus* host cell include *B. subtilis*, *B. licheniformis*, *B. megaterium*, *B. stearothermophilus* and *B. amyloliquefaciens*. In some embodiments the bacterial host cell is of the *Clostridium* species, e.g., *C. acetobutylicum*, *C. tetani* E88, *C. lituseburense*, *C. saccharobutylicum*, *C. perfringens*, and *C. beijerinckii*. In some embodiments the bacterial host cell is of the *Corynebacterium* species e.g., *C. glutamicum* and *C. acetoacidophilum*. In some embodiments the bacterial host cell is of the *Escherichia* species, e.g., *E. coli*. In some embodiments, the bacterial host cell is of the *Erwinia* species, e.g., *E. uredovora*, *E. carotovora*, *E. ananas*, *E. herbicola*, *E. punctata*, and *E. terreus*. In some embodiments the bacterial host cell is of the *Pantoea* species, e.g., *P. citrea*, and *P. agglomerans*. In some embodiments the bacterial host cell is of the *Pseudomonas* species, e.g., *P. putida*, *P. aeruginosa*, *P. mevalonii*, and P. sp. D-01 10. In some embodiments the bacterial host cell is of the *Streptococcus* species, e.g., *S. equisimiles*, *S. pyogenes*, and *S. uberis*. In some embodiments the bacterial host cell is of the *Streptomyces* species, e.g., *S. ambofaciens, S. achromogenes, S. avennitilis, S. coelicolor, S. aureofaciens, S. aureus, S. fungicidicus, S. griseus*, and *S. lividans*. In some embodiments the bacterial host cell is of the *Zymomonas* species, e.g., *Z. mobilis*, and *Z. lipolytica*.

Strains which may be used in the practice of the invention including both prokaryotic and eukaryotic strains, are readily accessible to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

Introduction of a vector or DNA construct into a host cell can be effected by calcium phosphate transfection, DEAE-Dextran mediated transfection, electroporation, or other common techniques (See Davis, L., Dibner, M. and Battey, I. (1986) *Basic Methods in Molecular Biology*, which is incorporated herein by reference). The engineered host cells can be cultured in conventional nutrient media modified as appropriate for activating promoters, selecting transformants, or amplifying the endoglucanase polynucleotide. Culture conditions, such as temperature, pH and the like, are those previously used with the host cell selected for expression, and will be apparent to those skilled in the art and in the references cited herein, including, for example, Sambrook, Ausubel and Berger, as well as, for example, Freshney (1994) *Culture of Animal Cells, a Manual of Basic Technique*, third edition, Wiley-Liss, New York; Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York) and Atlas and Parks (eds) *The Handbook of Microbiological Media* (1993) CRC Press, Boca Raton, Fla., all of which are incorporated herein by reference.

Fusion Polypeptides for Purification:

Endoglucanase polypeptides of the present invention may also be expressed as part of a fusion polypeptide to facilitate purification of the encoded endoglucanase polypeptide. Polynucleotides encoding such fusion polypeptides comprise a nucleic acid sequence corresponding to an endoglucanase polynucleotide of the present invention that is fused-in frame to a purification facilitating domain. As used herein, the term "purification facilitating domain" refers to a domain that mediates purification of the polypeptide to which it is fused. Suitable purification domains include metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; Wilson et al. (1984) *Cell*, 37:767, which is incorporated herein by reference), maltose binding protein sequences, the FLAG epitope utilized in the FLAGS extension/affinity purification system (Immunex Corp, Seattle, Wash.), and the like. The inclusion of a protease-cleavable polypeptide linker sequence between the purification domain and the endoglucanase polypeptide is useful to facilitate purification. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography, as described in Porath et al. (1992) *Protein Expression and Purification* 3:263-281, which is incorporated herein by reference) while the enterokinase cleavage site provides a means for separating the endoglucanase polypeptide from the fusion protein. pGEX vectors (Promega; Madison, Wis.) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Production and Recovery of Endoglucanase Polypeptides:

The present invention is directed to a method of producing a polypeptide having endoglucanase activity, the method comprising providing a host cell transformed with any one of the above-described endoglucanase polynucleotides of the present invention; culturing the transformed host cell in a culture medium under conditions that cause the polynucleotide to express the encoded endoglucanase polypeptide; and recovering or isolating the expressed endoglucanase polypeptide from the culture medium or from the cultured host cells or both.

In another embodiment, the present invention is directed to a method of producing a polypeptide having endoglucanase activity according to the invention, comprising culturing a host cell comprising any one of the above-described polynucleotides of the present invention in a culture medium under conditions that cause the polynucleotide to express the encoded endoglucanase polypeptide; and recovering or isolating the expressed endoglucanase polypeptide from the culture medium or from the cultured host cells or both.

Typically, recovery or isolation is from the host cell culture medium, the host cell or both, using protein recovery techniques that are well known in the art, including those described below.

Following transduction of a suitable host strain and growth (cultivating or culturing) of the host strain to an appropriate cell density, the selected promoter is induced by appropriate means (e.g., temperature shift or chemical induction) and cells are cultured for an additional period. Cells are typically harvested by centrifugation, disrupted by physical or chemical means, and the resulting crude extract may be retained for further purification. Microbial cells employed in expression of proteins can be disrupted by any convenient method, including freeze-thaw cycling, sonication, mechanical disruption, or use of cell lysing agents, or other methods, which are well known to those skilled in the art.

As noted, many references are available for the culture and production of many cells, including cells of bacterial, plant, animal (especially mammalian) and archebacterial origin. See e.g., Sambrook, Ausubel, and Berger (all supra), as well as Freshney (1994) *Culture of Animal Cells, a Manual of Basic Technique*, third edition, Wiley-Liss, New York and the references cited therein; Doyle and Griffiths (1997) *Mammalian Cell Culture: Essential Techniques* John Wiley and Sons, NY; Humason (1979) *Animal Tissue Techniques*, fourth edition W.H. Freeman and Company; and Ricciardelli, et al., (1989) *In vitro Cell Dev. Biol.* 25:1016-1024, all of which are incorporated herein by reference. For plant cell culture and regeneration, Payne et al. (1992) *Plant Cell and Tissue Culture in Liquid Systems*, John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York); Jones, ed. (1984) *Plant Gene Transfer and Expression Protocols*, Humana Press, Totowa, N.J. and *Plant Molecular Biology* (1993) R. R. D. Croy, Ed. Bios Scientific Publishers, Oxford, U.K. ISBN 0 12 198370 6, all of which are incorporated herein by reference. Cell culture media in general are set forth in Atlas and Parks (eds.) *The Handbook of Microbio-*

*logical Media* (1993) CRC Press, Boca Raton, Fla., which is incorporated herein by reference. Additional information for cell culture is found in available commercial literature such as the *Life Science Research Cell Culture Catalogue* (1998) from Sigma-Aldrich, Inc (St Louis, Mo.) ("Sigma-LSRCCC") and, for example, *The Plant Culture Catalogue* and supplement (1997) also from Sigma-Aldrich, Inc (St Louis, Mo.) ("Sigma-PCCS"), all of which are incorporated herein by reference.

In some embodiments, cells expressing the endoglucanase polypeptides of the invention are grown under batch or continuous fermentations conditions. Classical batch fermentation is a closed system, wherein the compositions of the medium is set at the beginning of the fermentation and is not subject to artificial alternations during the fermentation. A variation of the batch system is a fed-batch fermentation which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. Continuous fermentation is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady sate growth conditions. Methods for modulating nutrients and growth factors for continuous fermentation processes as well as techniques for maximizing the rate of product formation are well known in the art of industrial microbiology.

The resulting polypeptide may be recovered/isolated and optionally purified by any of a number of methods known in the art. For example, the polypeptide may be isolated from the nutrient medium by conventional procedures including, but not limited to, centrifugation, filtration, extraction, spray-drying, evaporation, chromatography (e.g., ion exchange, affinity, hydrophobic, chromatofocusing, and size exclusion), or precipitation. Protein refolding steps can be used, as desired, in completing the configuration of the mature protein. Finally, high performance liquid chromatography (HPLC) can be employed in the final purification steps. In addition to the references noted supra, a variety of purification methods are well known in the art, including, for example, those set forth in Sandana (1997) *Bioseparation of Proteins*, Academic Press, Inc.; Bollag et al. (1996) *Protein Methods*, $2^{nd}$ Edition, Wiley-Liss, NY; Walker (1996) *The Protein Protocols Handbook* Humana Press, NJ; Harris and Angal (1990) *Protein Purification Applications: A Practical Approach*, IRL Press at Oxford, Oxford, England; Harris and Angal *Protein Purification Methods: A Practical Approach*, IRL Press at Oxford, Oxford, England; Scopes (1993) *Protein Purification: Principles and Practice* $3^{rd}$ Edition, Springer Verlag, NY; Janson and Ryden (1998) *Protein Purification: Principles, High Resolution Methods and Applications, Second Edition*, Wiley-VCH, NY; and Walker (1998) *Protein Protocols on CD-ROM*, Humana Press, NJ, all of which are incorporated herein by reference. A procedure for recovering the endoglucanase polypeptide from a cell lysate is illustrated in Example 2.

Cell-free transcription/translation systems can also be employed to produce endoglucanase polypeptides using the polynucleotides of the present invention. Several such systems are commercially available. A general guide to in vitro transcription and translation protocols is found in Tymms (1995) *In vitro Transcription and Translation Protocols: Methods in Molecular Biology*, Volume 37, Garland Publishing, NY, which is incorporated herein by reference.

Methods of Using Endoglucanase Polypeptides and Related Compositions:

In some embodiments of the invention, an endoglucanase polypeptide is used in an enzyme composition. The enzyme composition comprising an endoglucanase of the invention may be combined with other cellulases to form a composition comprising a cellulase mixture. The cellulase mixture may include cellulases selected from other EGs, CBHs and β-glucosidases e.g., cellulases from *Trichoderma reesei, Acidothermus cellulolyticus, Thermobifida fusca, Humicola grisea, Myceliophthora thermophila* and *Chrysosporium* sp. The enzymes of the cellulase mixture work together resulting in decrystallization and hydrolysis of the cellulose from a biomass substrate to yield fermentable sugars, such as but not limited to glucose (Brigham et al., (1995) in Handbook on Bioethanol (C. Wyman ed.) pp 119-141, Taylor and Francis, Washington D.C.). Those skilled in the art are well aware of other cellulases which may be mixed with the EGs of the present invention and these include commercially available cellulases from Danisco, Genencor Division, Novozymes and Iogen. In some preferred embodiments, enzyme compositions comprise an EG encompassed by the invention and other EGs, CBHs and/or BGls and optionally enzymes selected from hemicellulases, esterases (e.g. lipases and cutinases), proteases, laccases, glucoamylases, alpha amylases, oxidoreductases, phytases, transferases, and mixtures thereof.

The enzyme compositions of the invention may be used in the production of monosaccharides, disaccharides or polysaccharides as chemical or fermentation feedstock from biomass. Biomass may be any carbon containing substrate including cellulose and starch substrates. In some embodiments, the biomass includes cellulosic substrates including but not limited to, wood, wood pulp, paper pulp, corn stover, corn fiber, rice, paper and pulp processing waste, woody or herbaceous plants, fruit or vegetable pulp, distiller's grain, grasses, rice hulls, wheat straw, cotton, hemp, flax, sisal, corn cobs, sugar cane bagasse, switch grass and mixtures thereof.

The biomass may optionally be pretreated using methods known in the art such as chemical, physical and biological pretreatments (e.g., steam explosion, pulping, grinding, acid hydrolysis, ammonia fiber explosion, biological pretreatment, mechanical pretreatment and combinations thereof). Pretreatment is preferably performed prior to hydrolysis (e.g. contacting the biomass with an enzyme composition according to the invention) but pretreatment can be carried out simultaneously with hydrolysis.

In some embodiments, the endoglucanase enzyme compositions may be reacted with a slurry comprising a biomass substrate in the temperature range of about 25° C. to 100° C., about 30° C. to 90° C., about 30° C. to 80° C., about 30° C. to 70° C. and also about 40° C. to 55° C. Also the biomass may be reacted with the endoglucanase enzyme composition at about 25° C., at about 30° C., at about 35° C., at about 40° C., at about 45° C., at about 50° C., at about 55° C., at about 60° C., at about 65° C., at about 70° C., at about 75° C., at about 80° C., at about 85° C., at about 90° C., at about 95° C. and at about 100° C. Generally the pH range will be from about pH 3.0 to 8.5, pH 3.5 to 8.5, pH 4.0 to 7.5, pH 4.0 to 7.0, pH 4.0 to 6.5 and pH 4.5 to 5.5. The incubation time may vary for example from 1.0 to 240 hours, from 5.0 to 180 hrs, from 10.0 to 150 hrs and from 24 to 96 hrs. For example, the reaction or incubation time will be at least 1 hr, at least 5 hrs, at least 10 hrs, at least 15 hrs, at least 25 hrs, at least 50 hr, at least 100 hrs, at least 180 and the like. Incubation of the cellulase under these conditions may result in the release of substantial amounts of the fermentable or soluble sugars from the biomass substrate. For example at least 20%, at least 30%, at least 40%, at least 50%, at least 60%, at least 70%, at least 80%, at least 90% or more soluble or fermentable sugars may be available as compared to the release of soluble or fermentable sugars by a parent polypeptide and particularly the polypeptide of SEQ ID NO: 2. In some embodiments, the fermentable sugars will be comprise glucose.

The fermentable or soluble sugars produced by the methods of the invention may be used in the production of other end-products such as but not limited to alcohols (e.g., ethanol, butanol, and xylitol), ketones (e.g. acetone), amino acids (e.g., glycine, lysine, glutamic acid, and aspartic acid), organic acids (e.g., lactic acid, ascorbic acid, adipic acid, gluconic acid, succinic acid), glycerol, 1, 3 propanediol, butanediol and animal feeds.

In some embodiments, the endoglucanase enzyme compositions of the invention may be used simultaneously in a fermentation with a fermenting microorganism to produce an end-product such as ethanol. In a simultaneous saccharification and fermentation (SSF) process the fermentable sugars (e.g., glucose) are removed from the system by the fermentation.

A fermenting microorganism is any microorganism (e.g. bacterial or fungal) that is suitable for a desired fermentation to produce a fermentation product. The fermenting microorganism may be a C5 and/or C6 fermenting microorganism including yeast strains such as *Saccharomyces* sp. (e.g., *S. cerevisiae*), *Pichia* sp. (e.g., *P. stipitis*), and *Candida* sp. Other fermenting microorganisms include *Zymomonas* (*Z. mobilis*), *E. coli*, *Clostridium* (*C. thermocellum*) and *Schizosaccharomyces* (*S. pombe*). Those of skill in the art are aware of commercially available yeast which are suitable for the production of ethanol, such as but not limited to SUPERSTART (Ethanol Technology, WI) and ETHANOL RED (Lesaffre).

In some embodiments, the fermenting microorganism will be a recombinant microorganism, wherein the microorganism has been engineered to ferment C5 sugars, such as xylose and/or arabinose.

In some embodiments, the invention relates to a method of converting a biomass substrate to fermentable sugars comprising contacting a biomass substrate with an enzyme composition encompassed by the invention under conditions suitable for the production of the fermentable sugars. In some embodiments, the biomass substrate is a cellulosic substrate selected from wheat grass, corn stover, and bagasse. In some embodiments, the biomass is pretreated. In other embodiments, the fermentable sugar comprises glucose. Suitable process time, temperature pH conditions can be readily determined by one of skill in the art. For example, in some embodiments, the contacting is at a temperature range of 25° C. to 75° C., at a pH range of 4.0 to 7.5, for a period of time of between 12 to about 96 hours. In some embodiments, the fermentable sugars may be isolated and further processed.

In some embodiments, the invention relates to a method for producing an alcohol comprising a) contacting a biomass substrate with an endoglucanase polypeptide encompassed by the invention under conditions suitable for the production of the fermentable sugars; b) contacting the fermentable sugars with a fermenting microorganism under suitable conditions to produce an alcohol and recovering the alcohol. The contacting steps may occur either sequentially or simultaneously (e.g., in a simultaneous saccharification and fermentation (SSF)). In some embodiments, the second contacting step is carried out at a temperature range of about 20° C. to about 60° C., also about 30° C. to about 50° C.; the pH range is about 3.0 to about 7.0 for a period of time of about 12 to about 96 hours. In some embodiments, the microorganism will be a yeast or a bacteria. In some embodiments, the yeast or bacteria will be an ethanol producing microorganism. In some embodiments, the end-product will be ethanol or butanol.

In addition, endoglucanase enzyme compositions of the invention may be used in various other industrial applications which include textile treatment, pulp and paper treatment, detergent applications and animal feeds.

The foregoing and other aspects of the invention may be better understood in connection with the following non-limiting examples.

EXAMPLES

Example 1

Wild Type *Clostridium thermocellum* celG Gene Acquisition and Construction of Expression Vector

*Clostridium thermocellum* endoglucanase celG encoding gene was designed for expression in an *E. coli* W3110 derived strain based on the reported amino acid sequence (Lemaire, et al. "Nucleotide Sequence of the celG Gene of *Clostridium thermocellum* and Characterization of Its Product, Endoglucanase CelG" 1993 *J. Bact.*, 175(11):3353-3360) and a codon optimization algorithm incorporated as described in Example 1 of WO2008042876. The celG gene was synthesized using oligonucleotides composed, e.g., of 42 nucleotides and cloned into an *E. coli* expression vector pCK110900 (example 1, FIG. 3) under the control of a lac promoter as described in US Pat. App. Pub. No. 2006 0195947. The expression vector contains the P15a origin of replication and the chloramphenicol resistance gene. In addition, the polynucleotide encoding the CelGcat domain was cloned into a pCK110900 vector. The resulting plasmids were transformed into the *E. coli* W3110 derived strain using standard methods. The sequence of the codon optimized celG gene (including the catalytic, linker, and dockerin domains) and the celGcat gene and the encoded polypeptides thereof are provided in FIGS. 2 and 3, respectively. The celG sequence and the celGcat sequence from the transformants were verified. CelG and/or CelGcat activity was confirmed using pNPC (p-nitrophenyl-β-D-cellobioside) as substrate as outlined by Lemaire, et al., "Nucleotide Sequence of the celG Gene of *Clostridium thermocellum* and Characterization of Its Product, Endoglucanase CelG" 1993 *J. Bact.*, 175(11):3353-3360. The activity of CelGcat was used as a reference for variant comparison.

Example 2

Production of CelGcat

Shake Flask Procedure

A single microbial colony of *E. coli* containing a plasmid with the *Clostridium thermocellum* endoglucanase celG gene was inoculated into 50 ml Terrific Broth (TB) (TB=12 g/L tryptone-peptone, 24 g/L yeast extract, 9.4 g/L $KH_2PO_4$, 2.2 g/L $K_2HPO_4$, 4% glycerol) containing 30 µg/ml chloramphenicol and 1% glucose. Cells were grown overnight (at least 16 hrs) in an incubator at 30° C. with shaking at 250 rpm. The culture was diluted into 250 mL TB, 30 µg/ml chloramphenicol in a 1 liter flask to an optical density at 600 nm (OD600) of 0.2 and allowed to grow at 30° C. Expression of the celG gene was induced with 1 mM IPTG (final concentration) when the OD600 of the culture was 0.6 to 0.8 and incubated overnight (at least 16 hrs). Cells were harvested by centrifugation (5000 rpm, 15 min, 4° C.) and the supernatant discarded. The cell pellet was re-suspended with an equal volume of cold (4° C.) 25 mM sodium acetate buffer, pH 5.0 and harvested by centrifugation as above. The washed cells were re-suspended in 10 ml of the cold 25 mM sodium acetate buffer pH 5.0 and lysed using the One Shot model cell disrupter (Constant Systems, Ltd., Sanford, N.C.) at 33.5 kpsi while maintaining the temperature at 4° C. Cell debris was removed by centrifugation (9000 rpm, 40 min., 4° C.). The clear lysate supernatant was collected and stored at −20° C. Subsequent lyophilization of frozen clear lysate provided dry powder of crude CelGcat.

Example 3

Production of CelGcat

Inoculation Shake Flask Procedure

A single microbial colony of *E. coli* containing a plasmid with the *Clostridium thermocellum* endoglucanase celG gene was inoculated into 2 ml M9YE broth (M9YE) (M9YE=1.0 g/L ammonium chloride, 0.5 g/L of sodium chloride, 6.0 g/L of disodium monohydrogen phosphate, 3.0 g/L of potassium dihydrogen phosphate, 2.0 g/L of Tastone-154 yeast extract), containing 30 µg/ml chloramphenicol and 1% glucose. Cells were grown overnight (at least 12 hrs) in an incubator at 37° C. with shaking at 250 rpm. 0.5 mL of this culture was diluted into 250 ml M9YE Broth containing 30 µg/ml chloramphenicol and 1% glucose in 1 liter flask and allowed to grow at 37° C. with shaking at 250 rpm. When the OD600 of the culture was 0.5 to 1.0 the cells were removed from the incubator and used immediately for inoculating fermentor, or stored at 4° C. until used.

Example 4

Production of *Clostridium thermocellum* CelGcat

Fermentation Procedure

In an aerated agitated 15 L fermentor, 6.0 L of growth medium containing 0.88 g/L ammonium sulfate, 0.98 g/L of sodium citrate, 12.5 g/L of dipotassium monohydrogen phosphate trihydrate, 6.25 g/L of potassium dihydrogen phosphate, 3.3 g/L of Tastone-154 yeast extract, 0.083 g/L ferric ammonium citrate, and 8.3 ml/L of trace element solution containing 2.0 g/L of calcium chloride dihydrate, 2.2 g/L of zinc sulfate septahydrate, 0.5 g/L manganese sulfate monohydrate, 1 g/L cupric sulfate heptahydrate, 0.1 g/L ammonium molybdate tetrahydrate and 0.02 g/L sodium tetraborate decahydrate was brought to a temperature of 37° C. The fermenter was inoculated with a late exponential culture of *E. coli* W3110, containing a plasmid with the *Clostridium thermocellum* endoglucanase celG gene, grown in a shake flask as described in Example 3 to a starting OD600 of 0.5 to 1.0. The fermentor was agitated at 250-1200 rpm and air was supplied to the fermentation vessel at 0.6-25.0 L/min to maintain dissolved oxygen level of 50% saturation. The pH of the culture was controlled at 7.0 by addition of 28% v/v ammonium hydroxide. Growth of the culture was maintained by the addition of a feed solution containing 500 g/L glucose monohydrate, 12 g/L ammonium chloride and 5.1 g/L magnesium sulfate anhydrous. After the culture reached an OD600 of 70±10, temperature set point of 30° C. was maintained, and the expression of CelG was induced by the addition of isopropyl-β-D-thiogalactoside (IPTG) to a final concentration of 1 mM. The culture was grown for another 18 hours. The culture was then chilled to 4° C. and maintained at 4° C. until harvested. Cells were harvested by centrifugation at 5000G for 30 minutes in a Sorval RC12BP centrifuge at 4° C. Harvested cells were used directly in the following downstream recovery process or were stored at 4° C. until such use.

The cell pellet was resuspended in 2 volumes of 5-25 mM sodium acetate buffer, pH 5, at 4° C. to each volume of wet cell paste. The intracellular CelGcat was released from the cells by passing the suspension through a homogenizer fitted with a two homogenizing valve assemblies (two-stage homogenization) first stage pressure is 12000 psig, second stage pressure is 1200 psig. The cell homogenate was cooled to 4° C. immediately after disruption. A solution of 11% w/v polyethyleneimine, pH 7.2, was added to the lysate to a final concentration of 0.5% w/v and stirred for 30 minutes. The resulting suspension was clarified by centrifugation at RCF 7300 in a standard laboratory centrifuge for 30 minutes. The clear supernatant was decanted and concentrated ten-fold using a cross-linked cellulose polymer ultrafiltration membrane with a molecular weight cut off of 30 kDa. The final concentrate was dispensed into shallow containers, frozen at −20° C. and lyophilized to powder. The CelGcat powder was stored at −80° C.

Example 5

Analytical Methods to Determine Native CelG Activity

A. p-nitrophenyl-β-D-cellobioside (pNPC) Assay:

A colorimetric pNPC (p-nitrophenyl-β-D-cellobioside)-based assay was used for measuring CelG activity. In a total volume of 150 µL, 20 µL clear lysate containing CelG enzyme was added to 5 mM pNPC (from Sigma) solution in 25 mM sodium acetate buffer, pH 3.3-5.5. After incubation at 65-70° C. for 2 hrs, 20 µL of the reaction mixture was quenched with 130 µL of 1M sodium carbonate pH 11 solution. The absorbance of the solution was measured at 405 nm to determine the conversion of pNPC to p-nitrophenyl. The release of p-nitrophenol ($\epsilon=17,700\ M^{-1}\ cm^{-1}$) was measured at 405 nm to calculate CelG activity. Detectable CelGcat activity (~15% as compared to under optimal conditions (pH 7, 65° C.) was observed under high throughput screening conditions (pH 4, 70° C.).

B. Cellulose Assay:

The native CelG activity was also determined using Avicel (microcrystalline cellulase) as substrate. In a total volume of 150 µL, 20 µL clear cell lysate containing CelG enzyme was added to 200 g/L Avicel in 25 mM sodium acetate buffer (pH 4-5.5). The reaction was incubated at 65-70° C. for 24 hours. Biotransformations were quenched with 300 µL of 10 mM sulfuric acid. Conversion of Avicel to soluble sugar oligomers was measured using an Agilent HPLC 1200 equipped with HPX-87H Ion exclusion column (300 mm×7.8 mm) with water as eluent at a flow rate of 1.0 mL/min at 80° C. The retention times of the cellotriose, cellobiose and glucose were 4.2, 4.7 and 5.8 minute respectively. Detectable CelG activity (~15% as compared to under optimal conditions (pH 7, 65° C.) was observed under high throughput screening conditions (pH 4, 70° C.).

Example 6

Evaluation of Native CelGcat Activity

Figure 4:
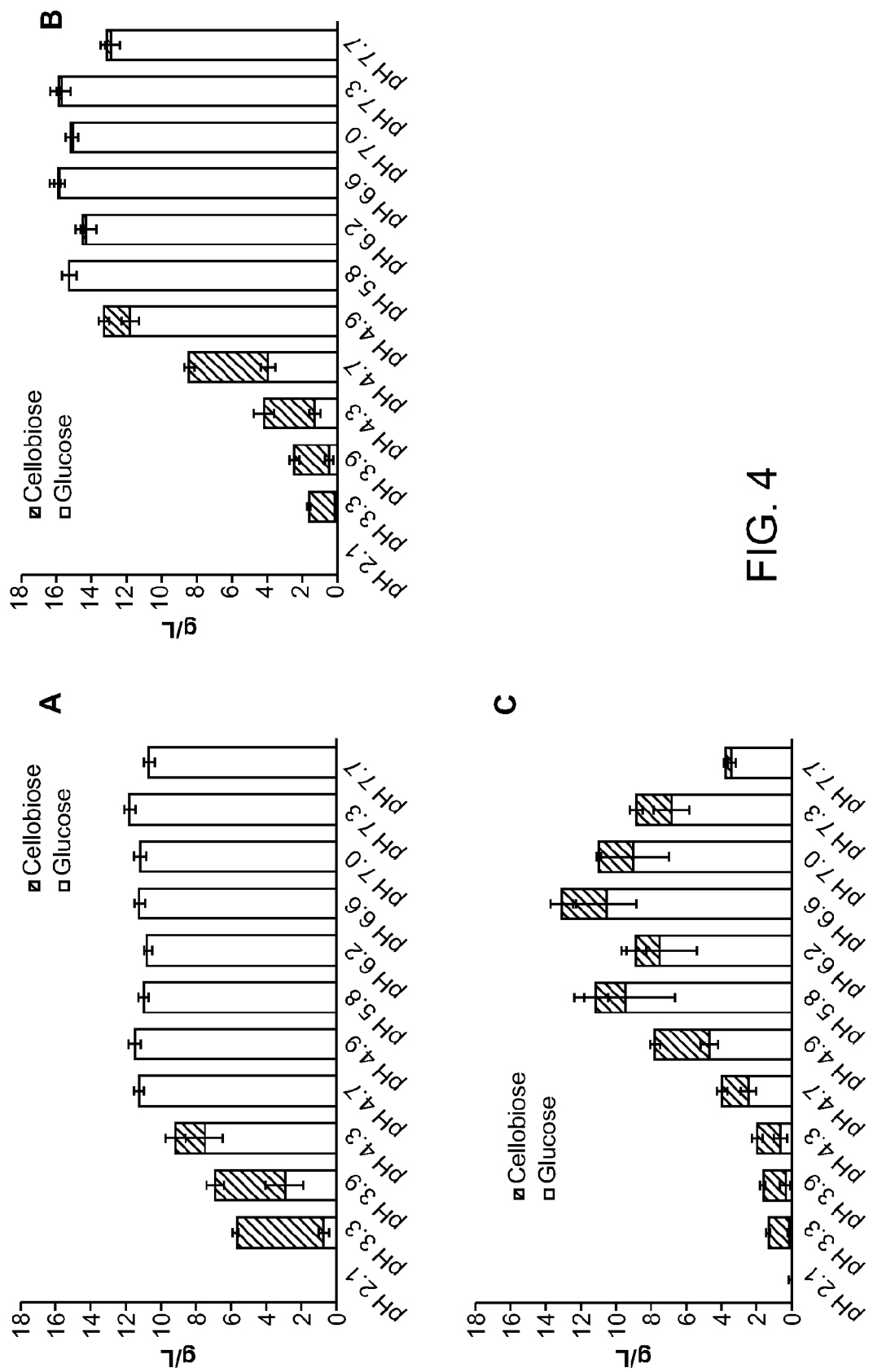
FIGS. 4A-C depict the native CelGcat activity profile at different temperatures 50° C. (A), 65° C. (B) and 70° C. (C) and a pH range of 2.1-7.7 using 200 g/L Avicel as a substrate under high throughput (HTP) conditions. The production of glucose and cellobiose was measured over a 24 hour period using both CelGcat and a β-glucosidase. CelGcat exhibited optimum activity at pH 6-7 and 65° C., and detectable CelGcat activity was observed at pH 4 and 70° C.

The native CelGcat activity profile was investigated at different temperatures (50, 65 and 70° C.) and pH (2.1-7.7) using Avicel (200 g/L) as a substrate. The experimental and analytical procedures are as described in Example 5. The resulting activity profiles are shown in FIG. 4A (50° C.), 4B (65° C.), and 4C (70° C.). CelGcat exhibited optimum activity at pH 6-7 and 65° C., and exhibited detectable CelGcat activity at pH 4 and 70° C. as shown in FIGS. 4A-C.

Example 7

High Throughput HPLC Assay to Identify Improved CelGcat Variants

Plasmid libraries containing celG catalytic domain variant genes were transformed into *E. coli* W3110 and plated on Luria-Bertani (LB) agar plates containing 1% glucose and 30 µg/mL chloramphenicol (CAM). After incubation for at least 18 hours at 30° C., colonies were picked using a Q-bot® robotic colony picker (Genetix USA, Inc., Beaverton, Oreg.) into shallow, 96-well well microtiter plates containing 180 µL LB, 1% glucose and 30 µg/mL CAM. Cells were grown overnight at 30° C. with shaking at 200 rpm and 85% humidity. 20 µL of the culture was transferred into 96-well microtiter plates (deep well) containing 380 µL TB medium and 30 µg/mL CAM. After incubation of deep-well plates at 30° C. with shaking at 250 rpm for 2 hours ($OD_{600}$ 0.6-0.8), recombinant gene expression by the cell cultures was induced by isopropyl thiogalactoside (IPTG) to a final concentration of 1 mM. The plates were incubated at 30° C. with shaking at 250 rpm and 85% humidity overnight (~15-18 hours).

Cells were pelleted via centrifugation, resuspended in 300 µL lysis buffer and lysed by shaking at room temperature for 2 hours. The lysis buffer contained 25 mM sodium phosphate buffer pH 7.0, 1 mg/mL lysozyme and 500 µg/mL polymixin B sulfate. The plates were centrifuged at 4000 rpm for 15 minutes and the clear supernatant (lysate) used for the high throughput pNPC or Avicel assay.

A. Tier 1: pNPC-Based High Throughput Assay

The CelG libraries were screened in high throughput using a tiered process. CelGcat variants were screened by a tier 1 colorimetric pNPC-based high throughput assay (Substrate: pNPC; pH: 4.0; temperature: 70° C.; time: 24 hrs). Active CelG variants identified from the tier 1 assay were subsequently subjected to the tier 2 HPLC assay described hereinbelow (Substrate: Avicel; pH: 4.0; temperature: 70° C.; time: 24 hrs) for the identification of improved variants.

In shallow, 96-well microtiter plates 20 µL of clear lysate was added to 130 µL of 5 mM pNPC in sodium acetate buffer pH 4.0. After sealing with aluminum/polypropylene laminate heat seal tape (Velocity 11 (Menlo Park, Calif.), Cat#06643-001), the plates were shaken at 70° C. for up to 24 hrs. The plates were centrifuged for 5 minutes at 4000 rpm. In shallow well (clear) microtiter plates, 20 µL of the reaction mixture was quenched with 130 µL of 1M sodium carbonate pH 11 solution per well. The solutions were gently mixed 3 times and absorbance was measured at 405 nm for the identification of active CelGcat variants.

B. Tier 2: Cellulose-Based Assay

In deep, 96-well microtiter plates 20 µL of clear lysate was added to 130 µL of 200 g/L Avicel (microcrystalline cellulose) in sodium acetate buffer pH 4.0. After sealing with aluminum/polypropylene laminate heat seal tape (Velocity 11 (Menlo Park, Calif.), Cat#06643-001), the plates were shaken at 70° C. for up to 24 hrs. The reactions were quenched by adding 300 µL of 10 mM sulfuric acid into the deep well plates. The plates were centrifuged at 4000 rpm for 5 minutes. 150 µL of supernatant from reaction mixture was filtered with 0.45 µm low-binding hydrophilic PTFE filter plate (Millipore, Billerica, Mass.). The HPLC sample plates were sealed with heat seal tape to prevent evaporation. As in Example 5, conversion of Avicel to soluble sugar oligomers was measured using an Agilent HPLC 1200 equipped with HPX-87H Ion exclusion column (300 mm×7.8 mm) with water as eluent at a flow rate of 1.0 mL/min at 80° C. The retention times of the cellotriose, cellobiose and glucose were 4.2, 4.7 and 5.8 minutes, respectively. Several improved CelGcat variants were identified from the screening of various CelG variant libraries. Results are shown in Table 2.

TABLE 2

Improved CelGcat Variants

| SEQ ID NO:: | Mutations relative to SEQ ID NO: 2 | Silent Mutations relative to SEQ ID NO: 1 | FI[1] over CelGcat SEQ ID NO: 2 |
|---|---|---|---|
| 4 | Y18V; I66V; H96Y; D109G; N146M; E148P; T224K; W270Y; I342L; V368I; N392Y; K429N | | ++++ |
| 6 | Y18V; F42L; I66V; H96Y; D109G; N146M; E148P; L206F; T224K; W270Y; V368I; N392Y; K429N; L433I | | ++++ |
| 8 | I66V; H96Y; D109G; N146M; E148P; D175E; T224K; K235N; W270Y; V368I; N392Y; K429N | | ++++ |
| 10 | I66V; H96Y; D109G; N146M; E148P; D175E; T224K; K235N; W270Y; V368I; N392Y; K416R; K429N | | ++++ |
| 12 | Y18V; I66V; D109G; N146M; E148P; T224K; K235N; W270Y; V368I; N392Y | | ++++ |
| 14 | Y18V; I66V; H96Y; D109G; N146M; E148P; T224K; K235N; W270Y; V368I; N392Y; K429N | | ++++ |
| 16 | Y18V; F42L; I66V; H96Y; D109G; N146M; E148P; D175E; L206F; T224K; W270Y; V368I; N392Y; K416R | | ++++ |
| 18 | I66V; D109G; E148P; W270Y; V368I; N392Y | | ++++ |
| 20 | Y18V; I66V; H96Y; D109G; E148P; W270Y; V368I; N392Y; K416R; K429N | | +++ |
| 22 | Y18V; I66V; D109G; N146M; E148P; K235N; W270Y; V368I; N392Y | | +++ |
| 24 | I66V; H96Y; D109G; N146M; E148P; K235N; W270Y; V368I; N392Y; K429N; L433I | | +++ |
| 26 | V2F; I66V; H96Y; D109G; E148P; W270Y; V368I; N392Y; | | +++ |
| 28 | M20K; Y21N; I66V; S90V; D109G; E148P; E231A; W270Y; K283R; V368I; N392Y; P425S | g1284c | +++ |

TABLE 2-continued

Improved CelGcat Variants

| SEQ ID NO: | Mutations relative to SEQ ID NO: 2 | Silent Mutations relative to SEQ ID NO: 1 | FI[1] over CelGcat SEQ ID NO: 2 |
|---|---|---|---|
| 30 | Y18V; I66V; D109G; N146I; E148P; Y308H; V368I; N392Y | | +++ |
| 32 | I66V; D109G; N146I; E148P; W270Y; V368I; N392Y | g201a | +++ |
| 34 | I66V; H96Y; D109G; E148P; K235N; W270Y; V368I; N392Y | | +++ |
| 36 | I66V; H96Y; D109G; N146M; E148P; D175E; L206F; T224K; K235N; W270Y; I342L; V368I; N392Y | | +++ |
| 38 | S38R; I66V; H96Y; D109G; N146T; E148P; Y255W; V368I; G384S; N392Y | | +++ |
| 40 | Y18V; F42L; I66V; D109G; N146M; E148P; K235N; W270Y; V368I; N392Y | | +++ |
| 42 | I66V; H96Y; D109G; N146M; E148P; D175E; K235N; W270Y; V368I; N392Y; K429N | | +++ |
| 44 | K16R; D58E; I66V; D109G; E148P; T199S; W270Y; V368I; N392Y; T412S | | +++ |
| 46 | F42L; I66V; D109G; E148P; W270Y; V368I; N392Y; | | +++ |
| 48 | Y18V; I66V; D109G; E148P; T224K; W270Y; V368I; N392Y; K429N; | | +++ |
| 50 | Y18V; I66V; H96Y; D109G; E148P; W270Y; V368I; N392Y | | +++ |
| 52 | Y18V; F42L; I66V; H96Y; D109G; S143M; N146E; E148P; D175E; T224K; K235N; W270Y; V368I; N392Y; K429N | | +++ |
| 54 | Y18V; F42L; I66V; H96Y; D109G; S143M; N146M; E148P; D175E; L206F; T224K; Y255W; W270Y; V368I; N392Y | | +++ |
| 56 | Y18V; F42L; I66V; H96Y; D109G; S143M; N146M; E148P; T224K; Y255W; W270Y; I342L; V368I; N392Y; K429N; L433I | | +++ |
| 58 | I66V; H96Y; D109G; N146M; E148P; D175E; T224K; W270Y; I342L; V368I; N392Y | | +++ |
| 60 | S38R; A57V; I66V; H96Y; D109G; N146I; E148P; W270Y; V368I; N392Y | | +++ |
| 62 | V2I; I66V; D109G; E148P; W270Y; V368I; N392Y | g615t | +++ |
| 64 | D8Y; Y18V; I66V; D109G; N146I; E148P; Y308H; Y328R; V368I; N392Y | | +++ |
| 66 | Y18V; I66V; D109G; N146I; E148P; L206F; E231A; Y308A; V368I; N392Y | | +++ |
| 68 | Y18V; I66V; D109G; N146I; E148P; Y308H; Y328R; V368I; N392Y | | +++ |
| 70 | S38R; I66V; H96Y; D109G; S143M; E148P; Y255W; V368I; N392Y | | +++ |
| 72 | S38R; A57V; I66V; H96Y; D109G; N146I; E148P; H193M; W270Y; V368I; N392Y | | +++ |
| 74 | Y18V; I66V; D109G; S143M; E148P; T224K; W270Y; V368I; N392Y; K429N | | +++ |
| 76 | Y18V; I66V; H96Y; D109G; N146M; E148P; L206F; T224K; K235N; Y255W; W270Y; V368I; N392Y; K429N | | +++ |
| 78 | Y18V; F42L; I66V; D109G; N146M; E148P; W270Y; V368I; N392Y; K429N | | +++ |
| 80 | D8Y; S38D; I66V; D109G; N146I; E148P; V368I; N392Y | | +++ |
| 82 | D8Y; Y18V; I66V; D109G; N146I; E148P; E231A; Y308A; V368I; N392Y | | +++ |
| 84 | S38R; F42L; I66V; H96Y; D109G; S143M; E148P; Y255W; V368I; N392Y | | +++ |
| 86 | Y18V; F42L; I66V; H96Y; D109G; S143M; N146M; E148P; T224K; Y255W; W270Y; V368I; N392Y; L433I | | +++ |
| 88 | Y18V; I66V; D109G; S143M; E148P; D175E; W270Y; V368I; N392Y; K416R | | +++ |
| 90 | I66V; E106K; D109G; E148P; W270Y; V368I; N392Y | | +++ |
| 92 | I66V; D109G; E148P; W270Y; V368I; N392Y | c445t; c633t | +++ |
| 94 | I66V; H96Y; D109G; S143M; E148P; L206F; T224K; K235N; W270Y; V368I; N392Y; K429N | | +++ |
| 96 | Y18V; F42L; I66V; H96Y; D109G; N146M; E148P; K235N; Y255W; W270Y; V368I; N392Y | | +++ |
| 98 | I66V; D109G; E148P; W270F; V368I; N392Y | | +++ |
| 100 | Y18V; F42L; I66V; H96Y; D109G; S143M; N146M; E148P; D175E; T224K; K235N; W270Y; V368I; N392Y | | +++ |
| 102 | Y18V; I66V; D109G; S143M; N146M; E148P; Y255W; W270Y; V368I; N392Y | | +++ |
| 104 | Y18V; I66V; D109G; E148P; K235N; W270Y; V368I; N392Y; K416R | | +++ |
| 106 | Y18V; I66V; H96Y; D109G; E148P; Y255W; W270Y; V368I; N392Y; K416R | | +++ |
| 108 | I66V; D109G; E148P; W270Y; V368I; N392Y | c324t | +++ |
| 110 | D8Y; S38R; F42L; I66V; H96Y; D109G; S143M; E148P; Y255W; V368I; N392Y | | +++ |

TABLE 2-continued

Improved CelGcat Variants

| SEQ ID NO:: | Mutations relative to SEQ ID NO: 2 | Silent Mutations relative to SEQ ID NO: 1 | FI[1] over CelGcat SEQ ID NO: 2 |
|---|---|---|---|
| 112 | I66V; S90V; H96Y; V98C; E106T; D108N; D109S; E148P; V368I; N392Y | | +++ |
| 114 | I66V; D109G; E148P; K235N; W270Y; V368I; N392Y | | +++ |
| 116 | I66V; D109G; E148P; V368I; N392Y; K423N | | ++ |
| 118 | I66V; D109G; E148P; W270I; V368I; N392Y | | ++ |
| 120 | Y18V; I66V; D109G; N146I; E148P; L206F; Y308Q; Y328R; V368I; N392Y | | ++ |
| 122 | I66V; D109G; N146I; E148P; V368I; N392Y | | ++ |
| 124 | I66V; D109G; N146I; E148P; L206F; Y308R; V368I; N392Y | | ++ |
| 126 | I66V; D109G; E148P; D256E; W270Y; V368I; N370I; N392Y | | ++ |
| 128 | S38R; F42L; I66V; H96Y; D109G; S143T; E148P; Y255W; V368I; G384R; N392Y | | ++ |
| 130 | I66V; D109G; E148P; W270F; V368I; N392Y; F417L | | ++ |
| 132 | I66V; S90V; H96Y; V98C; E106T; D108N; D109S; E126Q; I133V; I135V; E148P; V368I; N392Y | | ++ |
| 134 | S38R; I66V; H96Y; D109G; N146E; E148P; Y255W; V368I; G384H; N392Y | | ++ |
| 136 | Y18V; I66V; D109G; N146I; E148P; V368I; N392Y | | ++ |
| 138 | S38R; F42L; I66V; D109G; S143M; E148P; V368I; N392Y | | ++ |
| 140 | F42L; I66V; H96Y; D109G; S143M; E148P; Y255W; V368I; N392Y | | ++ |
| 142 | A57V; I66V; D109G; E148P; T224K; V368I; N392Y | | ++ |
| 144 | C41V; I66V; D109G; E148P; I342L; N392Y | | ++ |
| 146 | Y18V; I66V; D109G; N146I; E148P; V161I; V368I; N392Y | | ++ |
| 148 | S38R; I66V; T88N; H96Y; D109G; S143M; E148P; Y255W; V368I; N392Y; L433I | | ++ |
| 150 | Y18V; I66V; D109G; E148P; V368I; N392Y | | ++ |
| 152 | I66V; D109G; E148P; L206M; P291L; V368I; N392Y | | ++ |
| 154 | D58N; I66V; D109G; E148P; D288N; I296V; V368I; N392Y; T412D; K413S | | ++ |
| 156 | S38R; I66V; H96Y; D109G; E148P; V368I; N392Y | | ++ |
| 158 | V2I; I66V; D109G; E148P; V368I; N392Y | | ++ |
| 160 | S38R; I66V; D109G; E148P; V368I; N392Y | | ++ |
| 162 | D58N; I66V; D109G; E148P; V368I; N392Y; K423Q | g1284c | ++ |
| 164 | I66V; D109G; E148P; L206M; V368I; N392Y | | ++ |
| 166 | I66V; D108N; D109G; E148P; V368I; N392Y | | ++ |
| 168 | I66V; D109G; E148P; A309P; V368I; N392Y | | ++ |
| 170 | F42L; I66V; H96Y; D109G; E148P; Y255W; V368I; N392Y | | ++ |
| 172 | S38R; F42L; I66V; D109G; E148P; Y255W; V368I; N392Y | | ++ |
| 174 | S38R; I66V; D109G; S143M; E148P; Y255W; V368I; N392Y | | ++ |
| 176 | I66V; D109G; E148P; S156T; C158A; D288N; V368I; N392Y | | ++ |
| 178 | S38R; I66V; D109G; E148P; Y255W; V368I; G384S; N392Y | | ++ |
| 180 | D58N; I66V; D109G; E148P; D288N; V368I; N392Y; L433I | | ++ |
| 182 | D58N; I66V; D109G; E148P; V368I; N392Y; K423Q | | ++ |
| 184 | I66V; H96Y; D109G; E148P; V368I; N392Y | | ++ |
| 186 | S38R; I66V; D109G; S143T; E148P; V368I; N392Y | | ++ |
| 188 | I66V; D109G; E148P; K283V; V368I; N392Y; K423Q | | ++ |
| 190 | S38R; F42L; I66V; T88N; D109G; N146M; E148P; V368I; G384D; N392Y | | ++ |
| 192 | S38R; I66V; D109G; S143M; E148P; V368I; N392Y | | ++ |
| 194 | S38R; I66V; T88N; H96Y; D109G; E148P; Y255W; V368I; N392Y | | ++ |
| 196 | S38R; F42L; I66V; H96Y; D109G; E148P; Y255W; V368I; G384H; N392Y | | ++ |
| 198 | I66V; D109G; E148P; S156T; C158A; D288N; V368I; N392Y; T412D; K413S | | ++ |
| 200 | I66V; D109G; N146I; E148P; V161I; Y308A; V368I; N392Y | | ++ |
| 202 | D58N; I66V; D109G; E148P; S156T; V368I; N392Y; K423Q | | ++ |
| 204 | I66V; D109G; N146F; E148P; V368I; N392Y | | ++ |
| 206 | S38R; I66V; T88N; D109G; S143M; E148P; V368I; N392Y | | ++ |
| 208 | D58N; I66V; D109G; E148P; S156T; K283R; D288N; L292Y; V368I; N392Y; K423Q; L433I | | ++ |
| 210 | D58N; I66V; D109G; E148P; V368I; N392Y | | ++ |
| 212 | S38R; I66V; D109G; S143M; E148P; Y255C; V368I; N392Y | | ++ |

TABLE 2-continued

Improved CelGcat Variants

| SEQ ID NO:: | Mutations relative to SEQ ID NO: 2 | Silent Mutations relative to SEQ ID NO: 1 | FI[1] over CelGcat SEQ ID NO: 2 |
|---|---|---|---|
| 214 | F42I; A57V; I66V; D109G; E148P; T224K; K235N; V368I; N392Y | | ++ |
| 216 | S38R; I66V; D109G; E148P; Y255W; V368I; N392Y | | ++ |
| 218 | C41V; I66V; D109G; E148P; V368I; N392Y | | ++ |
| 220 | I66V; D109G; E148P; L292H; V368I; N392Y | | ++ |
| 222 | D109G; E148P; I342L; N392Y | | + |
| 224 | I66V; D109G; E148P; Q357E; K429N; | | + |
| 226 | I66V; D109G; E148P; K204T; Q357E; N392Y; | | + |
| 228 | I66V; D109G; E148P; V368I; N392Y | | + |
| 230 | C41V; I66V; D109G; E148P; V171E; N392Y; K429N | | + |
| 232 | D109G; E148P; D256T; V368I; N392Y | | + |
| 234 | I66V; D109G; N392Y; | | + |
| 236 | I66V; D109G; E148P; V171E; V368I; N392Y | | + |
| 238 | L362I | | + |
| 240 | D109G; E148P; V171E; D256T; N392Y | | + |
| 242 | I66V; D109G; E148P; D256T; M319K; N392Y | | + |
| 244 | I66V; D109G; E148P; K429N | | + |
| 246 | I66V; D109G; E231A; I342L | | + |
| 248 | C41V; I66V; D109G; E148P | | + |
| 250 | C41V; I66V; D109G; V171E; N392Y | | + |
| 252 | D109G; E148P; I342L; K429N | | + |
| 254 | D109G; E148P; Q357E; N392Y | | + |
| 256 | D109G; E148P; V171E; N392Y | | + |
| 258 | D109G; E148P; V171E; N392Y; K429N | | + |
| 260 | I66V; D109G; E148P; D256T; V368I | | + |
| 262 | C41V; D109G; E148P; K429N | | + |
| 264 | I66V; D109G; E148P; V171E; K204T; N392Y | | + |
| 266 | I66V; D109G; D256T | | + |
| 268 | I66V; D109G; K429N | | + |
| 270 | I66V; D109G; E148P | | + |
| 272 | C41V; I66V; D109G; E148P; E231A; I342L; Q357E; K429N | | + |
| 274 | C41V; I66V; D109G; E148P; K164E; Q357E; N392Y; K429N | | + |
| 276 | C41V; I66V; D109G; E148P; K204T; N392Y | | + |
| 278 | I66V; D109G; D256T; I342L | | + |
| 280 | C41V; I66V; D109G; E148P; M319K; Q369E | | + |
| 282 | C41V; I66V; D109G; E148P; D256T | | + |
| 284 | I66V; D109G; E148P; V171E; D256T | | + |
| 286 | I66V; D109G; E148P; V171E; D256T; Q357E; N392Y; K429N | | + |
| 288 | D109G; N392Y | | + |
| 290 | I66V; D109G; E148P | c1104t | + |
| 292 | D109G; E148P; D256T | | + |
| 294 | W270Y | | + |
| 296 | C41V; I66V; D109G; E148P; D256T; K429N | | + |
| 298 | D109G; E148P; V171E; D256T; Q369E; N392Y | | + |
| 300 | C41V; D109G; E148P; Q357E; V368I | | + |
| 302 | C41V; I66V; E148P; Q357E; N392Y | | + |
| 304 | D109G; E148P; N392Y | | + |
| 306 | I66V; E148P; V368I; N392Y | | + |
| 308 | I66V; D109G; E148P; V171E; K429N | | + |
| 310 | D109G; V171E; Q357E; N392Y | | + |
| 312 | C41V; I66V; D109G; E148P; K204T; Q357E; N392Y | | + |
| 314 | D109G; E148P; K429N | | + |
| 316 | I66V; D256T; N392Y | | + |
| 318 | D109G; Q357E; N392Y; K429N | | + |
| 320 | I66V; D109G; D256T; Q369E; N392Y | | + |
| 322 | D109G; E148P; E231A | | + |
| 324 | D329V | g432a; g858a | + |
| 326 | I66V; D109G; D256T; N392Y | | + |
| 328 | D109G; M319K; N392Y | | + |
| 330 | D109G; E231A; I342L; K429N | | + |
| 332 | I66V; E148P; V171E; N392Y | | + |
| 334 | D256N; L343Q | | + |
| 336 | D109G; D256T; Q357E; N392Y | | + |
| 338 | N62S | g201a; g1224a | + |
| 340 | D180E; V236L | c405t; g432a | + |
| 342 | D109G; D256T | | + |
| 344 | M319V | g1107a | + |
| 346 | V97I; T361M | g66a; g210t | + |
| 348 | I66V; D109G; E148P; I342L | | + |
| 350 | I66V; D109G | | + |
| 352 | D109G; Q357E | | + |
| 354 | L292P | | + |
| 356 | D8E | g189a | + |
| 358 | V236A; M319V | | + |
| 360 | I66V; D109G; D256T; Q357E; K429N | | + |
| 362 | I66V; M319K; N392Y; K429N | | + |
| 364 | C41V; I66V; E148P; K164E; N392Y; K429N | | + |
| 366 | D109G; E148P; Q357E | | + |
| 368 | M114L; D256G | g432a | + |
| 370 | I287T | | + |
| 372 | M351V | | + |
| 374 | C41V; I66V; D109G; I342L | | + |
| 376 | A185T | c1254a | + |
| 378 | Y328D | | + |
| 380 | E399D | | + |
| 382 | I66V; E148P; D256T; K429N | | + |
| 384 | K153I | a1257t | + |

TABLE 2-continued

Improved CelGcat Variants

| SEQ ID NO:: | Mutations relative to SEQ ID NO: 2 | Silent Mutations relative to SEQ ID NO: 1 | FI[1] over CelGcat SEQ ID NO: 2 |
|---|---|---|---|
| 386 | I66V; D109G; V368I; K429N | | + |
| 388 | D58N; I66V; E148P; V171E; E231A; Q357E | | + |
| 390 | I66V; D109G; V171E; D256T; K429N | | + |
| 392 | A226T; I238T | | + |
| 394 | D214G | | + |
| 396 | I66V; N392Y | | + |
| 398 | G14A | t507a; c639t | + |
| 400 | D109G; E148P | | + |
| 402 | E148P; M319K; N392Y | | + |
| 404 | I66V; D109G; E148P; V171E; K204T; M319K; K429N | | + |
| 406 | D109G; E148P; I342L; Q357E | | + |
| 408 | D109G; E148P; K204T; K429N | | + |
| 410 | C41V; E148P; V368I; N392Y | | + |
| 412 | P286L; H373Q | | + |
| 414 | T254N; V297L | t924c | + |
| 416 | I66V; D109G; Q357E | | + |
| 418 | D109G; E148P; V171E; E231A; M319K | | + |
| 420 | E148P; N392Y | | + |
| 422 | D3G; H373L | t1068c | + |
| 424 | L173F | c552t; g927a; g1059a | + |
| 426 | C41V; D109G; E148P | | + |
| 428 | C41V; D109G; M319K; N392Y | | + |
| 430 | C41V; D109G; E148P; V171E; Q357E | | + |
| 432 | V243I; G438C | c36t | + |
| 434 | D109G; E148P; K164E; D256T | | + |
| 436 | S294M; P425H | | + |
| 438 | I287F | | + |
| 440 | T224K | c855t | + |
| 442 | I66V; K204T | | + |
| 444 | V2H | | + |
| 446 | L390F; I418V | | + |
| 448 | E148P; K429N | | + |
| 450 | C41V; D109G; E148P; M319K; V368I | | + |
| 452 | V2K | | + |
| 454 | I66V; D109G; V171E; Q357E; K429N | | + |
| 456 | G122W | | + |
| 458 | V25M; A403V | t606c; a1167g | + |
| 460 | C41V; I66V; D109G; E148P; K164E; D256T; M319K; I342L; N392Y | | + |
| 462 | K416R | | + |
| 464 | H350L; K429I | t1185c | + |
| 466 | I61F; R371C | | + |
| 468 | V2G | | + |
| 470 | E148P; M319K; V368I; N392Y | | + |
| 472 | D104E; K204R | t865c | + |
| 474 | V2R | | + |
| 476 | F42L; G265C; S294L; A408T | | + |

Figure 5:
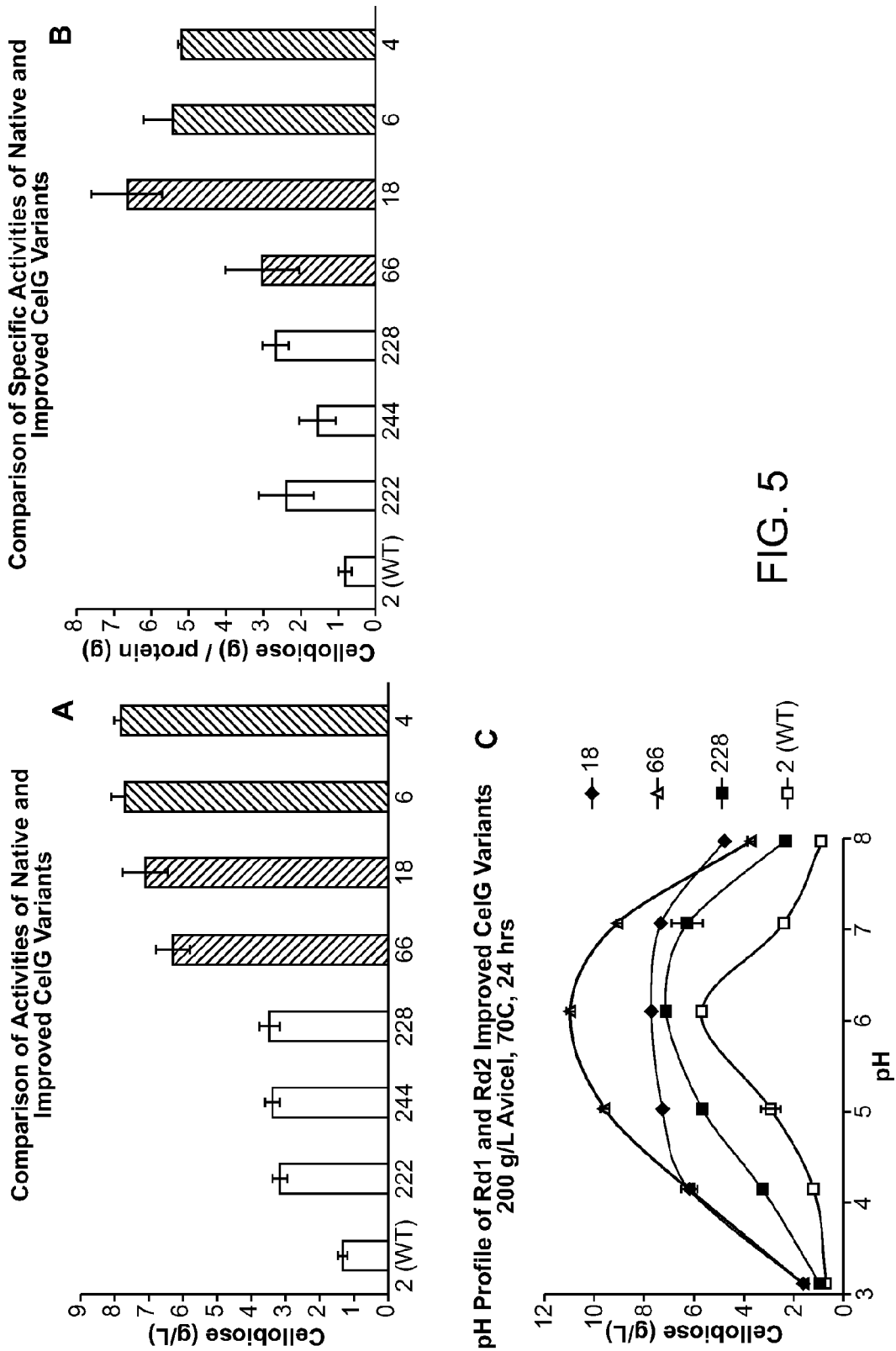
FIGS. 5A-C illustrates the improvement of variant endoglucanases of the present invention over CelGcat.
Figure 6:
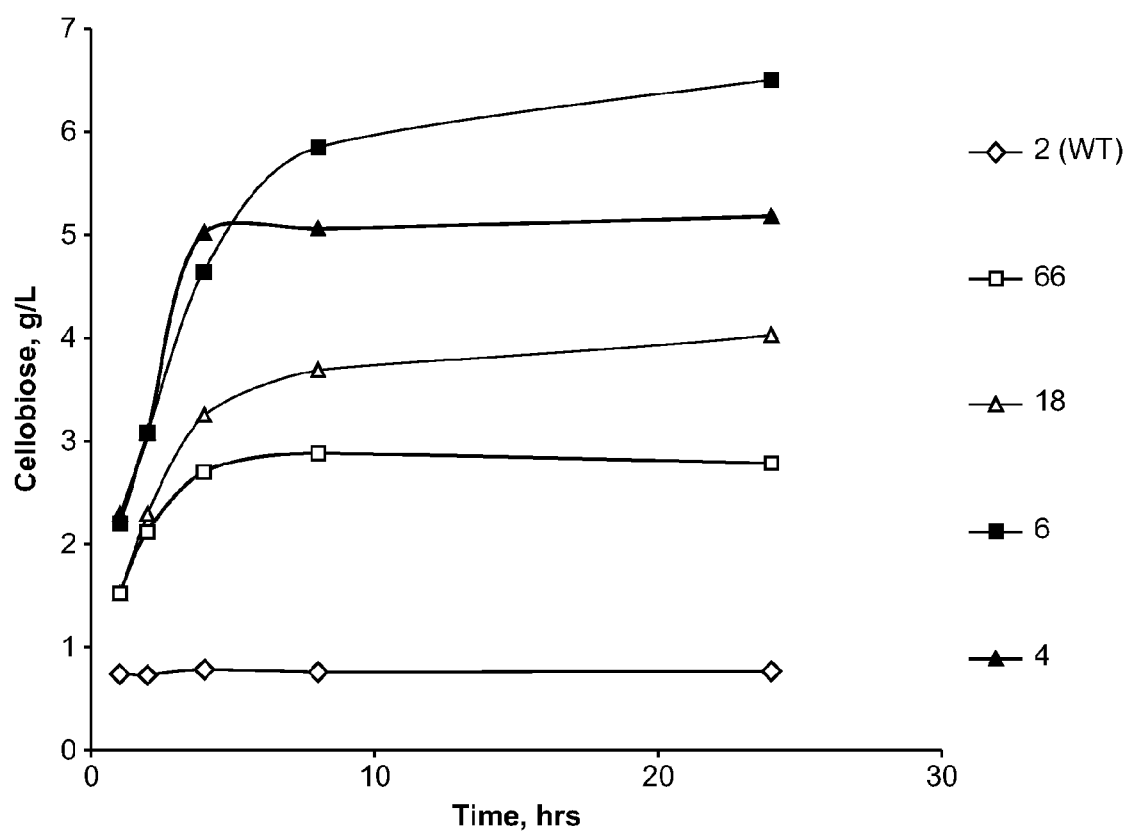
FIG. 6 depicts the production of cellobiose (g/L) over a 24 hour (hr) period for endoglucanase variants as compared to CelGcat ("2(WT)") under saccharification process conditions, 100 g/L Avicel, pH 4, 70° C. Each variant is represented by its sequence identifier, for example "66" means SEQ ID NO: 66.

[1]Fold improvement is represented as follows: + = 1.5 to 3.0 fold improvement ++ = 3.1 to 5.0 fold improvement +++ = 5.1 to 7.0 fold improvement ++++ = 7.1 to 8.0 fold improvement The best CelGcat variants exhibited at least an eight-fold improvement. Reference is made to FIGS. 5A-C, which illustrates the improvements in activity (A), specific activity (B), and the pH profiles (C) for some endoglucanases of the present invention. The variants in these Figures are identified by their SEQ ID NOs. The improved CelGcat variants were characterized and validated under saccharification conditions. FIG. 6A depicts the results for the production of cellobiose over 24 hours by various endoglucanases of the present invention (identified by their SEQ ID NOs) under the conditions of: 100 g/L Avicel, pH 4, 70° C. FIG. 6B depicts the results for the production of glucose over 24 hours by various endoglucanases of the present invention (identified by their SEQ ID NOs) under the conditions which included a beta-glucosidase.

While preferred embodiments of the invention have been illustrated and described, it will be readily appreciated that various changes can be made therein without departing from the spirit and scope of the invention.

SEQUENCE LISTING (478 sequences)

SEQ ID NO: 1 - DNA, 1314 bp, Artificial Sequence
  Synthetic codon optimized Clostridium thermocellum endoglucanase
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 2 - protein, 438 aa, Clostridium thermocellum
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 3 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccattgctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 4 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 5 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttccatcggagagtactacggc

SEQ ID NO: 6 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLFAKWDNSTDENNWKYAAEKCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISIGEYYG

SEQ ID NO: 7 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 8 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLAEKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 9 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtcgcttcatcggactcgatcacaaaattcctctggggtcgaatgggatttcccttggagagtactacggc

SEQ ID NO: 10 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLAEKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGRFIGLDHKIPLGSNGISLGEYYG

SEQ ID NO: 11 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 12 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 13 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 14 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 15 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtcgcttcatcggactcgatcacaaaattcctctggggtcgaaagggatttcccttggagagtactacggc

SEQ ID NO: 16 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLAEKYKNDDTIIAFDLKNEPHGKRGYTAEVPKLFAKWDNSTDENNWKYAAEKCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGRFIGLDHKIPLGSKGISLGEYYG

SEQ ID NO: 17 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 18 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 19 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtcgcttcatcggactcgatcacaaaattcctctggggtcgaatgggatttcccttggagagtactacggc

SEQ ID NO: 20 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGRFIGLDHKIPLGSNGISLGEYYG

SEQ ID NO: 21 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 22 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 23 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttccatcggagagtactacggc

SEQ ID NO: 24 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISIGEYYG

SEQ ID NO: 25 - DNA, 1314 bp, Artificial Sequence
  Synthetic CelG Variant
atgtttgatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 26 - protein, 438 aa, Artificial Sequence
  Synthetic CelG Variant
MFDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 27 - DNA, 1314 bp, Artificial Sequence
  Synthetic CelG Variant
atggtagatagtaataatgatgactggctgcattgcaaaggcaataaaatctacgataagaacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcggtgaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggccgtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtccgcgattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaatttctctggggtccaaagggatttcccttggagagtactacggc

SEQ ID NO: 28 - protein, 438 aa, Artificial Sequence
  Synthetic CelG Variant
MVDSNNDDWLHCKGNKIYDKNGNEVWLTGANWFGFNCSENCFHGAWYDVKTILTSIADRGINLLRVPISTELLYSWMIGKPNPVSSVTAVNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPYYSAWWGGNLRGVRDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKISLGSKGISLGEYYG

SEQ ID NO: 29 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtacacgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 30 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVHAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 31 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccaatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 32 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 33 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 34 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 35 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccattgctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 36 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLAEKYKNDDTIIAFDLKNEPHGKRGYTAEVPKLFAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 37 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacacgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagttccgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 38 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHTYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSSDTGGLLGYDWSTWDEAKYALLKPALWQTKDGKFIGLDHKIPLGSKGISLGEYYG

SEQ ID NO: 39 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 40 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 41 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 42 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLAEKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 43 - DNA, 1315 bp, Artificial Sequence
  Synthetic CelG Variant
atggtagatagtaataatgatgactggctgcattgcaaaggcaatcgcatctacgatatgtacgggaatgaagtgtggttgactggtgccaactggtttggcttcaactgcagcgagaactgttttcatggagcgtggtatgacgtgaaaaccattctcacaagcatcgccgaacgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacagcgccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagtctaaggatggtaaattcatcggactcgatcacaaaattcctctggggtcgaaagggatttcccttggagagtactacggcc

SEQ ID NO: 44 - protein, 438 aa, Artificial Sequence
  Synthetic CelG Variant
MVDSNNDDWLHCKGNRIYDMYGNEVWLTGANWFGFNCSENCFHGAWYDVKTILTSIAERGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYSAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQSKDGKFIGLDHKIPLGSKGISLGEYYG

SEQ ID NO: 45 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 46 - protein, 438 aa, Artificial Sequence
  Synthetic CelG Variant
MVDSNNDDWLHCKGNKIYDMYGNEVWLTGANWFGFNCSENCLHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 47 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 48 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 49 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 50 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 51 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacgaatatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 52 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHEYPLWYGKETSTCGVVTTKMWIDTLVWLAEKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 53 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 54 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHMYPLWYGKETSTCGVVTTKMWIDTLVWLAEKYKNDDTIIAFDLKNEPHGKRGYTAEVPKLFAKWDNSTDENNWKYAAEKCAKAILEVNPKVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 55 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccattgctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttccatcggagagtactacggc

SEQ ID NO: 56 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHMYPLWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIIQNRIHHTFWCINPNSGDTGGLLGYDWSTWDEAKYALLKPALWQTKDGKFIGLDHKIPLGSNGISIGEYYG

SEQ ID NO: 57 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccattgctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 58 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLAEKYKNDDTIIAFDLKNEPHGKRGYTAEVPKLLAKWDNSTDENNWKYAAEKCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 59 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgtagaccgtggcatcaatctgctgcgtgtgccgatctccacggaattactgtattcttggatgattggcaagccgaatccagtttcctcggtaaccgcgagtaacaatccaccgtactatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatctatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 60 - protein, 438 aa, Artificial Sequence
  Synthetic CelG Variant
MVDSNNDDWLHCKGNKIYDMYGNEVWLTGANWFGFNCRENCFHGAWYDVKTILTSIVDRGINLLRVPISTELLYSWMIGKPNPVSSVTASNNPPYYVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 61 - DNA, 1314 bp, Artificial Sequence
  Synthetic CelG Variant
atgatagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaacttctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 62 - protein, 438 aa, Artificial Sequence
  Synthetic CelG Variant
MIDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 63 - DNA, 1314 bp, Artificial Sequence
  Synthetic CelG Variant
atggtagatagtaataatgattactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtacacgcgcaaccgtggttcgagaaagactttaccatgcagacgctcttggatgattattggcgtgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 64 - protein, 438 aa, Artificial Sequence
  Synthetic CelG Variant
MVDSNNDYWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVHAQPWFEKDFTMQTLLDDYWRDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 65 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtagctgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 66 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLFAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVAAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 67 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtacacgcgcaaccgtggttcgagaaagactttaccatgcagacgctcttggatgattattggcgtgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 68 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVHAQPWFEKDFTMQTLLDDYWRDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 69 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 70 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 71 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgtagaccgtggcatcaatctgctgcgtgtgccgatctccacggaattactgtattcttggatgattggcaagccgaatccagtttcctcggtaaccgcgagtaacaatccaccgtactatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatctatccgctgtggtacggcaaagaaacctccacatgcggtgtcgtgaccacaaagatgtggattgacactttagtatggctcgctgataagtataaaaatgacgacaccatcatcgcgtttgatttgaaaaacgaacccatgggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 72 - protein, 438 aa, Artificial Sequence
  Synthetic CelG Variant
MVDSNNDDWLHCKGNKIYDMYGNEVWLTGANWFGFNCRENCFHGAWYDVKTILTSIVDRGINLLRVPISTELLYSWMIGKPNPVSSVTASNNPPYYVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPMGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 73 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 74 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 75 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 76 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLFAKWDNSTDENNWKYAAEKCAKAILEVNPNVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 77 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 78 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 79 - DNA, 1314 bp, Artificial Sequence
  Synthetic CelG Variant
atggtagatagtaataatgattactggctgcattgcaaaggcaataaaatctacgatatgtacgggaatgaagtgtggttgactggtgccaactggtttggcttcaactgcgacgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 80 - protein, 438 aa, Artificial Sequence
  Synthetic CelG Variant
MVDSNNDYWLHCKGNKIYDMYGNEVWLTGANWFGFNCDENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 81 - DNA, 1314 bp, Artificial Sequence
  Synthetic CelG Variant
atggtagatagtaataatgattactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtagctgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 82 - protein, 438 aa, Artificial Sequence
  Synthetic CelG Variant
MVDSNNDYWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVAAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 83 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 84 - protein, 438 aa, Artificial Sequence
  Synthetic CelG Variant
MVDSNNDDWLHCKGNKIYDMYGNEVWLTGANWFGFNCRENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 85 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttccatcggagagtactacggc

SEQ ID NO: 86 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHMYPLWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISIGEYYG

SEQ ID NO: 87 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtcgcttcatcggactcgatcacaaaattcctctggggtcgaaagggatttcccttggagagtactacggc

SEQ ID NO: 88 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHNYPLWYGKETSTCGVVTTKMWIDTLVWLAEKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGRFIGLDHKIPLGSKGISLGEYYG

SEQ ID NO: 89 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctaagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 90 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPKTDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 91 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgttgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataattccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 92 - protein, 438 aa, Artificial Sequence; identical to SEQ ID NO: 18
  Synthetic CelG Variant

SEQ ID NO: 93 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaatgggatttcccttggagagtactacggc

SEQ ID NO: 94 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLFAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSNGISLGEYYG

SEQ ID NO: 95 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 96 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 97 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgttttattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 98 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPFYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 99 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgtctgcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacatgtatccgctgtggtacggcaaagaaacctccacatgcggtgtcgtgaccacaaagatgtggattgacactttagtatggctcgctgaaaagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 100 - protein, 438 aa, Artificial Sequence
  Synthetic CelG Variant
MVDSNNDDWLHCKGNKIVDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHMYPLWYGKETSTCGVVTTKMWIDTLVWLAEKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 101 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 102 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHMYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 103 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtcgcttcatcggactcgatcacaaaattcctctggggtcgaaagggatttcccttggagagtactacggc

SEQ ID NO: 104 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGRFIGLDHKIPLGSKGISLGEYYG

SEQ ID NO: 105 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtcgcttcatcggactcgatcacaaaattcctctggggtcgaaagggatttcccttggagagtactacggc

SEQ ID NO: 106 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGRFIGLDHKIPLGSKGISLGEYYG

SEQ ID NO: 107 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgatggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 108 - protein, 438 aa, Artificial Sequence; identical to SEQ ID NO: 18
  Synthetic CelG Variant

SEQ ID NO: 109 - DNA, 1314 bp, Artificial Sequence
  Synthetic CelG Variant
atggtagatagtaataatgattactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 110 - protein, 438 aa, Artificial Sequence
  Synthetic CelG Variant
MVDSNNDYWLHCKGNKIYDMYGNEVWLTGANWFGFNCRENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 111 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcggtcaacaatccaccgtactatgtatgcaacccggacttctacgatcctacaaccaactcagttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 112 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTAVNNPPYYVCNPDFYDPTTNSVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 113 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaacgtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 114 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPNVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 115 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaacattcctctggggtcgaaagggatttcccttggagagtactacggc

SEQ ID NO: 116 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHNIPLGSKGISLGEYYG

SEQ ID NO: 117 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgatttattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 118 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPIYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 119 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtacaggcgcaaccgtggttcgagaaagactttaccatgcagacgctcttggatgattattggcgtgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 120 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLFAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVQAQPWFEKDFTMQTLLDDYWRDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 121 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 122 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 123 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgtttgcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtacgcgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 124 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLFAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVRAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 125 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgagacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagattcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 126 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYETPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQIRIHHTFWCINPNSGDTGGLLGYDWSTWDEAKYALLKPALWQTKDGKFIGLDHKIPLGSKGISLGEYYG

SEQ ID NO: 127 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactatgtagtcaacccggacttctacgatcctgagaccgacggcgttaagaacagcatggaaatcttcgatattattatggggtactgtaaagaactgggcatcaaagttatgatcgatatccactccccggatgctaataatacggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtcgtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 128 - protein, 438 aa, Artificial Sequence
  Synthetic CelG Variant
MVDSNNDDWLHCKGNKIYDMYGNEVWLTGANWFGFNCRENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNTGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSRDTGGLLGYDWSTWDEAKYALLKPALWQTKDGKFIGLDHKIPLGSKGISLGEYYG

SEQ ID NO: 129 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgttttattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaactcatcggactcgatcacaaaattcctctggggtcgaaagggatttcccttggagagtactacggc

SEQ ID NO: 130 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPFYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKLIGLDHKIPLGSKGISLGEYYG

SEQ ID NO: 131 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcggtcaacaatccaccgtactatgtatgcaacccggacttctacgatcctacaaccaactcagttaagaacagcatggaaatcttcgatattattatggggtactgtaaacaactgggcatcaaagttatggtggatgttcactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 132 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTAVNNPPYYVCNPDFYDPTTNSVKNSMEIFDIIMGYCKQLGIKVMVDVHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 133 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacgagtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtcatgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 134 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHEYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSHDTGGLLGYDWSTWDEAKYALLKPALWQTKDGKFIGLDHKIPLGSKGISLGEYYG

SEQ ID NO: 135 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 136 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 137 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 138 - protein, 438 aa, Artificial Sequence
  Synthetic CelG Variant
MVDSNNDDWLHCKGNKIYDMYGNEVWLTGANWFGFNCRENCLHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 139 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 140 - protein, 438 aa, Artificial Sequence
  Synthetic CelG Variant
MVDSNNDDWLHCKGNKIYDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 141 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgtagaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 142 - protein, 438 aa, Artificial Sequence
  Synthetic CelG Variant
MVDSNNDDWLHCKGNKIYDMYGNEVWLTGANWFGFNCSENCFHGAWYDVKTILTSIVDRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 143 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 144 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 145 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcattaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 146 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVITTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 147 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaatgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttccatcggagagtactacggc

SEQ ID NO: 148 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVNASNNPPYYVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISIGEYYG

SEQ ID NO: 149 - DNA, 1314 bp, Artificial Sequence
  Synthetic CelG Variant
atggtagatagtaataatgatgactggctgcattgcaaaggcaataaaatcgtggatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 150 - protein, 438 aa, Artificial Sequence
  Synthetic CelG Variant
MVDSNNDDWLHCKGNKIVDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 151 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgatggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcctgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 152 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLMAKWDNSTDENNWKYAAETCAKAILEVNPKVLIVIEGVEQYPKTEKGYTYDTPDIWGATGDASPWYSAWWGGNLRGVKDYPIDLGLLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 153 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattaatttaggcccgctgaactcgcaggttgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcaggacagcgatggtaaattcatcggactcgatcacaaaattcctctggggtcgaaagggatttcccttggagagtactacggc

SEQ ID NO: 154 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPINLGPLNSQVVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQDSDGKFIGLDHKIPLGSKGISLGEYYG

SEQ ID NO: 155 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 156 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 157 - DNA, 1314 bp, Artificial Sequence
  Synthetic CelG Variant
atgatagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 158 - protein, 438 aa, Artificial Sequence
  Synthetic CelG Variant
MIDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 159 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 160 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 161 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcaccaaattcctctggggtccaaagggatttcccttggagagtactacggc

SEQ ID NO: 162 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHQIPLGSKGISLGEYYG

SEQ ID NO: 163 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgatggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 164 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLMAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 165 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccaacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 166 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETNGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 167 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatccgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 168 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYPQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 169 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 170 - protein, 438 aa, Artificial Sequence
  Synthetic CelG Variant
MVDSNNDDWLHCKGNKIYDMYGNEVWLTGANWFGFNCSENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 171 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 172 - protein, 438 aa, Artificial Sequence
  Synthetic CelG Variant
MVDSNNDDWLHCKGNKIYDMYGNEVWLTGANWFGFNCRENCLHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 173 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 174 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 175 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaaccaccacagcgggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattaatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 176 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETTTAGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPINLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 177 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagttccgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 178 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSSDTGGLLGYDWSTWDEAKYALLKPALWQTKDGKFIGLDHKIPLGSKGISLGEYYG

SEQ ID NO: 179 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattaatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttccatcggagagtactacggc

SEQ ID NO: 180 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPINLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISIGEYYG

SEQ ID NO: 181 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcaccaaattcctctggggtcgaaagggatttcccttggagagtactacggc

SEQ ID NO: 182 - protein, 438 aa, Artificial Sequence; identical to SEQ ID NO: 162
  Synthetic CelG Variant

SEQ ID NO: 183 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 184 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 185 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatacggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 186 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNTGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 187 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtccgcgattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcaccaaattcctctggggtcgaaagggatttcccttggagagtactacggc

SEQ ID NO: 188 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVRDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHQIPLGSKGISLGEYYG

SEQ ID NO: 189 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaatgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatgtatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtgatgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 190 - protein, 438 aa, Artificial Sequence
  Synthetic CelG Variant
MVDSNNDDWLHCKGNKIYDMYGNEVWLTGANWFGFNCRENCLHGAWYDVKTILTSIADRGINLLRVPISTELLYSWMIGKPNPVSSVNASNNPPYHVVNPDFYDPETDGVKNSMEIFDIIMGYCKELGIKVMIDIHSPDANNSGHMYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSDDTGGLLGYDWSTWDEAKYALLKPALWQTKDGKFIGLDHKIPLGSKGISLGEYYG

SEQ ID NO: 191 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 192 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 193 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaatgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 194 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVNASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 195 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgtttacatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtactacgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtcatgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 196 - protein, 438 aa, Artificial Sequence
  Synthetic CelG Variant
MVDSNNDDWLHCKGNKIYDMYGNEVWLTGANWFGFNCRENCLHGAWYDVKTILTSIADRGINLLRVPISTELLYSWMIGKPNPVSSVTASNNPPYYVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSHDTGGLLGYDWSTWDEAKYALLKPALWQTKDGKFIGLDHKIPLGSKGISLGEYYG

SEQ ID NO: 197 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaaccaccacagcgggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattaatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcaggacagcgatggtaaattcatcggactcgatcacaaaattcctctggggtcgaaagggatttcccttggagagtactacggc

SEQ ID NO: 198 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETTTAGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPINLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQDSDGKFIGLDHKIPLGSKGISLGEYYG

SEQ ID NO: 199 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacatttatccgctgtggtacggcaaagaaacctccacatgcggtgtcattaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtagctgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 200 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHIYPLWYGKETSTCGVITTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVAAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 201 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaaccaccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcaccaaattcctctggggtcgaaagggatttcccttggagagtactacggc

SEQ ID NO: 202 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDGVKNSMEIFDIIMGYCKELGIKVMIDIHSPDANNSGHNYPLWYGKETTTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHQIPLGSKGISLGEYYG

SEQ ID NO: 203 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacttttatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 204 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHFYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 205 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaatgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 206 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVNASNNPPYHVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 207 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaaccaccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtccgcgattacccgattaatttaggcccgtacaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcaccaaattcctctggggtcgaaagggatttccatcggagagtactacggc

SEQ ID NO: 208 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDGVKNSMEIFDIIMGYCKELGIKVMIDIHSPDANNSGHNYPLWYGKETTTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVRDYPINLGPYNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHQIPLGSKGISIGEYYG

SEQ ID NO: 209 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 210 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 211 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataatatggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgcgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 212 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNMGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTCDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 213 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgtattcatggagcgtggtatgacgtgaaaaccattctcacaagcatcgtagaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaaatgtgctaaagcaattttggaagtgaacccgaatgtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 214 - protein, 438 aa, Artificial Sequence
  Synthetic CelG Variant
MVDSNNDDWLHCKGNKIYDMYGNEVWLTGANWFGFNCSENCIHGAWYDVKTILTSIVDRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAEKCAKAILEVNPNVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 215 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgccgcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctgggacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 216 - protein, 438 aa, Artificial Sequence
  Synthetic CelG Variant
MVDSNNDDWLHCKGNKIYDMYGNEVWLTGANWFGFNCRENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTWDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 217 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 218 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 219 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgcataactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 220 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPHNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 221 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 222 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 223 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 224 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSNGISLGEYYG

SEQ ID NO: 225 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 226 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSKGISLGEYYG

SEQ ID NO: 227 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 228 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 229 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 230 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSNGISLGEYYG

SEQ ID NO: 231 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 232 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 233 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 234 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 235 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 236 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 237 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgatcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 238 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTILRDYIVQNRIHHTFWCINPNSGDTGGLLGNDWSTWDEAKYALLKPALWQTKDGKFIGLDHKIPLGSKGISLGEYYG

SEQ ID NO: 239 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 240 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 241 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 242 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 243 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 244 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 245 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 246 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 247 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 248 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 249 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 250 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 251 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 252 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 253 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 254 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSKGISLGEYYG

SEQ ID NO: 255 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 256 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 257 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 258 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSNGISLGEYYG

SEQ ID NO: 259 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 260 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGNDWSTWDEAKYALLKPALWQTKDGKFIGLDHKIPLGSKGISLGEYYG

SEQ ID NO: 261 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 262 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 263 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 264 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 265 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 266 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 267 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 268 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 269 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 270 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 271 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 272 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNEKWMTLLRDYIVQNRIHHTFWCINPNSGDTGGLLGNDWSTWDEAKYALLKPALWQTKDGKFIGLDHKIPLGSNGISLGEYYG

SEQ ID NO: 273 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacagaaatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 274 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTEMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSNGISLGEYYG

SEQ ID NO: 275 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 276 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 277 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 278 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 279 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtcgaaaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 280 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVENRIHHTFWCINPNSGDTGGLLGNDWSTWDEAKYALLKPALWQTKDGKFIGLDHKIPLGSKGISLGEYYG

SEQ ID NO: 281 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 282 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 283 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 284 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 285 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 286 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSNGISLGEYYG

SEQ ID NO: 287 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 288 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 289 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgttcagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 290 - protein, 438 aa, Artificial Sequence; identical to SEQ ID NO: 270
  Synthetic CelG Variant

SEQ ID NO: 291 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 292 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 293 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtattattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 294 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPYYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 295 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 296 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 297 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtcgaaaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 298 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVENRIHHTFWCINPNSGDTGGLLGYDWSTWDEAKYALLKPALWQTKDGKFIGLDHKIPLGSKGISLGEYYG

SEQ ID NO: 299 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcattcagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 300 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIIQNRIHHTFWCINPNSGDTGGLLGNDWSTWDEAKYALLKPALWQTKDGKFIGLDHKIPLGSKGISLGEYYG

SEQ ID NO: 301 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 302 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSKGISLGEYYG

SEQ ID NO: 303 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 304 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 305 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 306 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 307 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 308 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 309 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 310 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSKGISLGEYYG

SEQ ID NO: 311 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 312 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSKGISLGEYYG

SEQ ID NO: 313 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 314 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 315 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 316 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 317 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 318 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSNGISLGEYYG

SEQ ID NO: 319 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtcgaaaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 320 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVENRIHHTFWCINPNSGDTGGLLGYDWSTWDEAKYALLKPALWQTKDGKFIGLDHKIPLGSKGISLGEYYG

SEQ ID NO: 321 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 322 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 323 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcgggacacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccaattgatttaggcccgctgaactcgcagatcgtttatagtccgcatgattacggaccgtctgtatatgcgcaaccgtggttcgagaaagactttaccatgcagacgctcttggatgattattggtatgtcacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 324 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYVTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 325 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 326 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 327 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 328 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 329 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 330 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 331 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 332 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 333 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattcagattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 334 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYNTPDIWGATGDASPWYSAWWGGNLRGVKDYPIDLGPLNSQIVYSPHDYGPSVYAQPWFEKDFTMQTLLDDYWYDTWAYIHDQGIAPIQIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 335 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 336 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGYDWSTWDEAKYALLKPALWQTKDGKFIGLDHKIPLGSKGISLGEYYG

SEQ ID NO: 337 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcagtctgctgcgtattccaatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcactgtggcagaccaaggatggtaaattcatcggactcgatcacaaaattcctctggggtcgaaagggatttcccttggagagtactacggc

SEQ ID NO: 338 - protein, 438 aa, Artificial Sequence
  Synthetic CelG Variant
MVDSNNDDWLHCKGNKIYDMYGNEVWLTGANWFGFNCSENCFHGAWYDVKTILTSIADRGISLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 339 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatattcactccccggatgctaataattcgggacacaattatgagctgtggtacggcaaagaaacctccacatgcggtgtcgtgaccacaaagatgtggattgacactttagtatggctcgctgataagtataaaaatgaggacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaagctgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 340 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNEDTIIAFDLKNEPHGKRGYTAEVPKLLAKWDNSTDENNWKYAAETCAKAILEVNPKLLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 341 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 342 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 343 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccgtgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccaaaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 344 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTVQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 345 - DNA, 1314 bp, Artificial Sequence
  Synthetic CelG Variant
atggtagatagtaataatgatgactggctgcattgcaaaggcaataaaatctacgatatgtacggaaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccactgaattactgtattcttggatgattggcaagccgaatccagtttcctcggtaaccgcgagtaacaatccaccgtaccatatagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgatgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 346 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHIVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMMLLRDYIVQNRIHHTFWCINPNSGDTGGLLGNDWSTWDEAKYALLKPALWQTKDGKFIGLDHKIPLGSKGISLGEYYG

SEQ ID NO: 347 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 348 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 349 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 350 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 351 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 352 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSKGISLGEYYG

SEQ ID NO: 353 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgccgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 354 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPPNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 355 - DNA, 1314 bp, Artificial Sequence
  Synthetic CelG Variant
atggtagatagtaataatgatgagtggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctactgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 356 - protein, 438 aa, Artificial Sequence
  Synthetic CelG Variant
MVDSNNDEWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 357 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggcgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccgtgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 358 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKALIVIEGVEQYPKTEKGYTYDTPDIWGATGDASPWYSAWWGGNLRGVKDYPIDLGPLNSQIVYSPHDYGPSVYAQPWFEKDFTVQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 359 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 360 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSNGISLGEYYG

SEQ ID NO: 361 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 362 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSNGISLGEYYG

SEQ ID NO: 363 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacagaaatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 364 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTEMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSNGISLGEYYG

SEQ ID NO: 365 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 366 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSKGISLGEYYG

SEQ ID NO: 367 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcttggaaatcttcgatattattatggggtactgtaaagaactgggcatcaaagttatgatcgatatccactccccggatgctaataattcgggacacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacggcacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 368 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSLEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYGTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 369 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgactgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 370 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPTDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 371 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacgtggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 372 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHVDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 373 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 374 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 375 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcacgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcataggactcgatcacaaaattcctctggggtcgaaagggatttcccttggagagtactacggc

SEQ ID NO: 376 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIITFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 377 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattgggatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 378 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWDDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 379 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgatgctaaatacgcgctgcttaagccggcgctgtggcagaccaaggatggtaaattcatcggactcgatcacaaaattcctctggggtcgaaagggatttcccttggagagtactacggc

SEQ ID NO: 380 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDDAKYALLKPALWQTKDGKFIGLDHKIPLGSKGISLGEYYG

SEQ ID NO: 381 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 382 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 383 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcatagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggtctcgatcacaaaattcctctggggtcgaaagggatttcccttggagagtactacggc

SEQ ID NO: 384 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGIETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 385 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 386 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGNDWSTWDEAKYALLKPALWQTKDGKFIGLDHKIPLGSNGISLGEYYG

SEQ ID NO: 387 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccaaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 388 - protein, 438 aa, Artificial Sequence
  Synthetic CelG Variant
MVDSNNDDWLHCKGNKIYDMYGNEVWLTGANWFGFNCSENCFHGAWYDVKTILTSIANRGINLLRVPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSKGISLGEYYG

SEQ ID NO: 389 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 390 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 391 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtactaaagcaattttggaagtgaacccgaaggtgttgactgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 392 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCTKAILEVNPKVLTVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 393 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccggtgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 394 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTGENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 395 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 396 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 397 - DNA, 1314 bp, Artificial Sequence
  Synthetic CelG Variant
atggtagatagtaataatgatgactggctgcattgcaaagccaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacacattagtatggctcgctgataagtataaaaatgacgacaccatcatcgcgtttgatttgaaaaacgaaccccatggtaagcgtggctacacggccgaagttcccaaactgctggcaaagtgggataactccactgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 398 - protein, 438 aa, Artificial Sequence
  Synthetic CelG Variant
MVDSNNDDWLHCKANKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 399 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 400 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 401 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 402 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 403 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 404 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 405 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccactgctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 406 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPLLIGEWGGHMDGGKNEKWMTLLRDYIVQNRIHHTFWCINPNSGDTGGLLGNDWSTWDEAKYALLKPALWQTKDGKFIGLDHKIPLGSKGISLGEYYG

SEQ ID NO: 407 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 408 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 409 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 410 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 411 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacctgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccaacatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 412 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYLIDLGPLNSQIVYSPHDYGPSVYAQPWFEKDFTMQTLLDDYWYDTWAYIHDQGIAPILIGEWGGHMDGGKNQKWMTLLRDYIVQNRIQHTFWCINPNSGDTGGLLGNDWSTWDEAKYALLKPALWQTKDGKFIGLDHKIPLGSKGISLGEYYG

SEQ ID NO: 413 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtataactacgacacaccggatatttggggcgcgacaggcgacgcttctccgtggtattcagcctggtggggaggtaaccttcgtggcgtcaaagattacccgattgatttaggcccgctgaactcgcagatcctttatagtccgcatgattacggaccgtctgtatacgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 414 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYNYDTPDIWGATGDASPWYSAWWGGNLRGVKDYPIDLGPLNSQILYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 415 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 416 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSKGISLGEYYG

SEQ ID NO: 417 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggcggtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 418 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILAVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 419 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 420 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 421 - DNA, 1314 bp, Artificial Sequence
  Synthetic CelG Variant
atggtaggtagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaaccaaaaatggatgacgctcttacgtgattatatcgtccagaatcgcatccttcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 422 - protein, 438 aa, Artificial Sequence
  Synthetic CelG Variant
MVGSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRILHTFWCINPNSGDTGGLLGNDWSTWDEAKYALLKPALWQTKDGKFIGLDHKIPLGSKGISLGEYYG

SEQ ID NO: 423 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggttcgctgataagtataaaaatgacgacaccatcattgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcacaaccgtggttcgagaaagactttaccatgcagacgctcttggatgattattggtatgacacgtgggcatacatccatgaccagggtattgccccaattctgattggggaatggggtggtcacatggatggaggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 424 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWFADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 425 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 426 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 427 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 428 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 429 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 430 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSKGISLGEYYG

SEQ ID NO: 431 - DNA, 1314 bp, Artificial Sequence
  Synthetic CelG Variant
atggtagatagtaataatgatgactggctgcattgtaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaagggattgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactactgc

SEQ ID NO: 432 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGIEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYC

SEQ ID NO: 433 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacagaaatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 434 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTEMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 435 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaacatgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcatctggggtcgaaagggatttcccttggagagtactacggc

SEQ ID NO: 436 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNMQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIHLGSKGISLGEYYG

SEQ ID NO: 437 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgtttgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 438 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPFDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 439 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaaagtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattatccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 440 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAEKCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 441 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaccctgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 442 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPTLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 443 - DNA, 1314 bp, Artificial Sequence
  Synthetic CelG Variant
atgcacgatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 444 - protein, 438 aa, Artificial Sequence
  Synthetic CelG Variant
MHDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 445 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttatttggaaacgactggtctacctgggatgaagctaaatacgcgctgcttaagccggcgctgtggcagaccaaggatggtaaattcgtcggactcgatcacaaaattcctctggggtcgaaagggatttcccttggagagtactacggc

SEQ ID NO: 446 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLFGNDWSTWDEAKYALLKPALWQTKDGKFVGLDHKIPLGSKGISLGEYYG

SEQ ID NO: 447 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 448 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSNGISLGEYYG

SEQ ID NO: 449 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 450 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRIPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIIQNRIHHTFWCINPNSGDTGGLLGNDWSTWDEAKYALLKPALWQTKDGKFIGLDHKIPLGSKGISLGEYYG

SEQ ID NO: 451 - DNA, 1314 bp, Artificial Sequence
  Synthetic CelG Variant
atgaaagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 452 - protein, 438 aa, Artificial Sequence
  Synthetic CelG Variant
MKDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 453 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagaatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatgaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaacgggatttcccttggagagtactacggc

SEQ ID NO: 454 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYELWYGKETSTCGVVTTKMWIDTLEWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNEKWMTLLRDYIVQNRIHHTFWCINPNSGDTGGLLGNDWSTWDEAKYALLKPALWQTKDGKFIGLDHKIPLGSNGISLGEYYG

SEQ ID NO: 455 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatgtggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 456 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMWYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 457 - DNA, 1314 bp, Artificial Sequence
  Synthetic CelG Variant
atggtagatagtaataatgatgactggctgcattgcaaaggcaataaaatctacgatatgtacgggaatgaaatgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagtccccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttgcttggaaacgactggtctacctgggatgaagctaaatacgtgctgcttaagccggcgctgtggcagaccaaggatggtaaattcatcggactcgatcacaaaattcctctggggtcgaaagggatttcccttggagagtactacggc

SEQ ID NO: 458 - protein, 438 aa, Artificial Sequence
  Synthetic CelG Variant
MVDSNNDDWLHCKGNKIYDMYGNEMWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYVLLKPALWQTKDGKFIGLDHKIPLGSKGISLGEYYG

SEQ ID NO: 459 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaacgtgtttcatggagcgtggtatgacgtgaaaaccattctcacaagcatcgccgaccgtggcatcaatctgctgcgtgtgccgatctccacggaattactgtattcttggatgattggcaagccgaatccagtttcctcggtaaccgcgagtaacaatccaccgtaccatgtagtcaacccggacttctacgatcctgagaccgacggcgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacagaaatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacaccacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccactgctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 460 - protein, 438 aa, Artificial Sequence
  Synthetic CelG Variant
MVDSNNDDWLHCKGNKIYDMYGNEVWLTGANWFGFNCSENVFHGAWYDVKTILTSIADRGINLLRVPISTELLYSWMIGKPNPVSSVTASNNPPYHVVNPDFYDPETDGVKNSMEIFDIIMGYCKELGIKVMIDIHSPDANNSGHNYPLWYGKETSTCGVVTTEMWIDTLVWLADKYKNDDTIIAFDLKNEPHGKRGYTAEVPKLLAKWDNSTDENNWKYAAETCAKAILEVNPKVLIVIEGVEQYPKTEKGYTYTTPDIWGATGDASPWYSAWWGGNLRGVKDYPIDLGPLNSQIVYSPHDYGPSVYAQPWFEKDFTKQTLLDDYWYDTWAYIHDQGIAPLLIGEWGGHMDGGKNQKWMTLLRDYIVQNRIHHTFWCINPNSGDTGGLLGYDWSTWDEAKYALLKPALWQTKDGKFIGLDHKIPLGSKGISLGEYYG

SEQ ID NO: 461 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtagattcatcggactcgatcacaaaattcctctggggtcgaaagggatttcccttggagagtactacggc

SEQ ID NO: 462 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGRFIGLDHKIPLGSKGISLGEYYG

SEQ ID NO: 463 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtctcatggatgggggcaaaaatcaaaaatggatgacgctcttacgtgattatatcgtccagaatcgcatccatcatacgttctggtgtatcaaccccaatagtggtgatacgggcggtttacttggaaacgactggtccacctgggatgaagctaaatacgcgctgcttaagccggcgctgtggcagaccaaggatggtaaattcatcggactcgatcacaaaattcctctggggtcgatagggatttcccttggagagtactacggc

SEQ ID NO: 464 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGLMDGGKNQKWMTLLRDYIVQNRIHHTFWCINPNSGDTGGLLGNDWSTWDEAKYALLKPALWQTKDGKFIGLDHKIPLGSIGISLGEYYG

SEQ ID NO: 465 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcttcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaattgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 466 - protein, 438 aa, Artificial Sequence
  Synthetic CelG Variant
MVDSNNDDWLHCKGNKIYDMYGNEVWLTGANWFGFNCSENCFHGAWYDVKTILTSIADRGFNLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNCIHHTFWCINPNSGDTGGLLGNDWSTWDEAKYALLKPALWQTKDGKFIGLDHKIPLGSKGISLGEYYG

SEQ ID NO: 467 - DNA, 1314 bp, Artificial Sequence
  Synthetic CelG Variant
atgggtgatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 468 - protein, 438 aa, Artificial Sequence
  Synthetic CelG Variant
MGDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 469 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatccgctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccaaacagacgctcttggatgattattggtatgacacgtgggcatacatccatgaccagggtattgccccaattctgattggggaatggggtggtcacatggatgggggcaaaaatcaaaaatggatgacgctcttacgtgattatatcattcagaatcgcatccatcatacgttctggtgtatcaaccccaatagtggtgatacgggcggtttacttggatatgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 470 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYPLWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTKQTLLDDYWYDTWAYIHDQGIAPILIGEWGGHMDGGKNQKWMTLLRDYIIQNRIHHTFWCINPNSGDTGGLLGYDWSTWDEAKYALLKPALWQTKDGKFIGLDHKIPLGSKGISLGEYYG

SEQ ID NO: 471 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgaacctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccagactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatctaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 472 - protein, 438 aa, Artificial Sequence
  Synthetic CelG Variant
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYEPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPRLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 473 - DNA, 1314 bp, Artificial Sequence
  Synthetic CelG Variant
atgcgcgatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggc

SEQ ID NO: 474 - protein, 438 aa, Artificial Sequence
  Synthetic CelG Variant
MRDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYG

SEQ ID NO: 475 - DNA, 1314 bp, Artificial Sequence
  Synthetic CelG Variant
atggtagatagtaataatgatgactggctgcattgcaaaggcaataaaatctacgatatgtacgggaatgaagtgtggttgactggtgccaactggtttggcttcaactgcagcgagaactgtcttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacatgcgacgcttctccgtggtattcagcctggtggggaggtaaccttcgtggcgtcaaagattacccgattgatttaggcccgctgaacttgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccgacactgtggcagaccaaggatggtaaattcatcggactcgatcacaaaattcctctggggtcgaaagggatttcccttggagagtactacggc

SEQ ID NO: 476 - protein, 438 aa, Artificial Sequence
  Synthetic CelG Variant
MVDSNNDDWLHCKGNKIYDMYGNEVWLTGANWFGFNCSENCLHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATCDASPWYSAWWGGNLRGVKDYPIDLGPLNLQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPTLWQTKDGKFIGLDHKIPLGSKGISLGEYYG

SEQ ID NO: 477 - DNA, 1593 bp, Artificial Sequence
  Synthetic codon optimized Clostridium thermocellum endoglucanase
atggtagatagtaataatgatgactggctgcattgcaaaggcaataaaatctacgatatgtacgggaatgaagtgtggttgactggtgccaactggtttggcttcaactgcagcgagaactgttttcatggagcgtggtatgacgtgaaaaccattctcacaagcatcgccgaccgtggcatcaatctgctgcgtattccgatctccacggaattactgtattcttggatgattggcaagccgaatccagtttcctcggtaaccgcgagtaacaatccaccgtaccatgtagtcaacccggacttctacgatcctgagaccgacgacgttaagaacagcatggaaatcttcgatattattatggggtactgtaaagaactgggcatcaaagttatgatcgatatccactccccggatgctaataattcggggcacaattatgagctgtggtacggcaaagaaacctccacatgcggtgtcgtgaccacaaagatgtggattgacactttagtatggctcgctgataagtataaaaatgacgacaccatcatcgcgtttgatttgaaaaacgaaccccatggtaagcgtggctacacggccgaagttcccaaactgctggcaaagtgggataactccaccgatgaaaataattggaaatacgcggccgaaacgtgtgctaaagcaattttggaagtgaacccgaaggtgttgattgttatcgaaggggttgaacaatatccgaaaaccgaaaaagggtatacctacgacacaccggatatttggggcgcgacaggcgacgcttctccgtggtattcagcctggtggggaggtaaccttcgtggcgtcaaagattacccgattgatttaggcccgctgaactcgcagatcgtttatagtccgcatgattacggaccgtctgtatatgcgcaaccgtggttcgagaaagactttaccatgcagacgctcttggatgattattggtatgacacgtgggcatacatccatgaccagggtattgccccaattctgattggggaatggggtggtcacatggatgggggcaaaaatcaaaaatggatgacgctcttacgtgattatatcgtccagaatcgcatccatcatacgttctggtgtatcaaccccaatagtggtgatacgggcggtttacttggaaacgactggtctacctgggatgaagctaaatacgcgctgcttaagccggcgctgtggcagaccaaggatggtaaattcatcggactcgatcacaaaattcctctggggtcgaaagggatttcccttggagagtactacggcaccccgcaagctagcgacccgccggcaacaccgaccgccaccccaactaaacctgctgcgtcgtcaacgccgagtttcatctacggtgacatcaactccgatgggaatgtcaacagcaccgatctgggcatcttaaaacgcattatcgttaaaaacccaccagcctctgcgaacatggacgctgccgacgtcaatgcggatggaaaggtcaatagcacggattacaccgtgctgaagcgttacttattgcgttccattgacaaattaccacacacaaca

SEQ ID NO: 478 - protein, 531 aa, Clostridium thermocellum
MVDSNNDDWLHCKGNKIYDMYGNEVWLTGANWFGFNCSENCFHGAWYDVKTILTSIADRGINLLRIPISTELLYSWMIGKPNPVSSVTASNNPPYHVVNPDFYDPETDDVKNSMEIFDIIMGYCKELGIKVMIDIHSPDANNSGHNYELWYGKETSTCGVVTTKMWIDTLVWLADKYKNDDTIIAFDLKNEPHGKRGYTAEVPKLLAKWDNSTDENNWKYAAETCAKAILEVNPKVLIVIEGVEQYPKTEKGYTYDTPDIWGATGDASPWYSAWWGGNLRGVKDYPIDLGPLNSQIVYSPHDYGPSVYAQPWFEKDFTMQTLLDDYWYDTWAYIHDQGIAPILIGEWGGHMDGGKNQKWMTLLRDYIVQNRIHHTFWCINPNSGDTGGLLGNDWSTWDEAKYALLKPALWQTKDGKFIGLDHKIPLGSKGISLGEYYGTPQASDPPATPTATPTKPAASSTPSFIYGDINSDGNVNSTDLGILKRIIVKNPPASANMDAADVNADGKVNSTDYTVLKRYLLRSIDKLPHTT

What is claimed is:

1. An isolated endoglucanase polypeptide variant comprising an amino acid sequence that is at least 90% identical to the endoglucanase polypeptide of SEQ ID NO:2, comprising a substitution at position 166 and having at least one additional substitution of an amino acid residue at a position V2, D3, D8, G14, Y18, M20, Y21, V25, F42, A57, D58, 161, N62, S90, H96, V97, D104, D109, M114, G122, N146, E148, K153, L173, D175, D180, A185, K204, L206, D214, T224, A226, E231, K235, V236, 1238, V243, T254, D256, W270, K283, P286, 1287, D288, L292, S294, 1296, V297, M319, Y328, D329, 1342, L343, H350, Q357, T361, L362, V368, Q369, R371, H373, L390, N392, E399, A403, K416, 1418, K423, P425, K429, and/or L433, wherein amino acid position is determined by alignment with SEQ ID NO:2.

2. The isolated variant of claim 1, wherein the substitution at position I66 is I66V and the at least one additional substitution is selected from V2/F/G/K/H/R, D3G, D8E, G14A, Y18V, M20K, Y21N, V25M, F42L, A57V, D58N, I61F, N62S, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, W270F/Y/I, K283R, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, and/or L433I, wherein amino acid position is determined by alignment with SEQ ID NO:2, and wherein the sequence of the variant polypeptide does not contain the substitution S38R.

3. The isolated endoglucanase polypeptide variant of claim 1 comprising an amino acid sequence that is at least about 90% identical to SEQ ID NO:2 and having at least one additional substitution at a position selected from Y18, H96, D109, N146, E148, T224, E231, K235, W270, I342, V368, N392, K429, and/or L433, wherein amino acid position is determined by alignment with SEQ ID NO:2.

4. The isolated endoglucanase polypeptide of claim 3, wherein the endoglucanase has at least substitutions at positions I66 and D109.

5. The isolated endoglucanase polypeptide of claim 3, wherein the at least one additional substitution is selected from Y18V, H96Y, D109G/S, N146I/E/M, E148P, T224K, E231A, K235N, W270Y, and/or K429I/N.

6. The isolated or recombinant endoglucanase polypeptide of claim 1, wherein the polypeptide exhibits at least about 1.5-fold greater endoglucanase activity than the wild type *Clostridium thermocellum* endoglucanase having the amino acid sequence of SEQ ID NO:2 as measured in the assay of Example 7B.

7. An isolated endoglucanase polypeptide variant comprising an amino acid sequence that is at least 90% identical to the wildtype endoglucanase polypeptide of SEQ ID NO:478 and having at least one substitution selected from V2/F/G/K/H/R, D3G, D8E, G14A, Y18V, M20K, Y21N, V25M, F42L, A57V, D58N, I61F, N62S, I66V, S90V, H96Y, V97I, D104E, D109G/S, M114L, G122W, N146I/E/M, E148P, K153I, L173F, D175E, D180E, A185T, K204R/T, L206F, D214G, T224K, A226T, E231A, K235N, V236A/L, I238T, V243I, T254N, D256G/N/T, K283R, W270F/Y/I, P286L, I287F/T, D288N, L292P, S294L/M, I296V, V297L, M319K/V, Y328D/R, D329V, I342L, L343Q, H350L, Q357E, T361M, L362I, V368I, Q369E, R371C, H373L/Q, L390F, N392Y, E399D, A403V, K416R, I418V, K423N, P425H, K429I/N, L433I and/or G444C, wherein amino acid position is determined by alignment with SEQ ID NO:478, and wherein the sequence of the variant polypeptide does not contain the substitution S38R.

8. A method of producing cellobiose, said method comprising:
(a) providing (i) a cellulose substrate and (ii) the endoglucanase polypeptide of claim 1; and
(b) contacting the cellulose substrate with the endoglucanase polypeptide under conditions sufficient to form a reaction mixture for converting the cellulose to cellobiose.

9. A method for producing glucose, said method comprising:
(a) providing (i) a cellulose substrate; (ii) the endoglucanase polypeptide of claim 1; and (iii) a β-glucosidase; and
(b) contacting the cellulose substrate with the endoglucanase polypeptide and the β-glucosidase under conditions sufficient to form a reaction mixture for converting the cellulose substrate to glucose.

10. An enzyme composition comprising the endoglucanase polypeptide of claim 1.

11. The enzyme composition of claim 10 further comprising one or more additional cellulase enzymes.

12. The enzyme composition of claim 10, wherein said composition is used for cellulose hydrolysis.

13. A method of converting a biomass substrate to fermentable sugars comprising contacting a biomass substrate with an enzyme composition according to claim 10 under conditions suitable for the production of the fermentable sugars.

14. The method according to claim 13 further comprising recovering the fermentable sugars.

15. The method according to claim 13, further comprising contacting the fermentable sugars with a fermenting microorganism under suitable conditions to produce a fermentation product and recovering the fermentation product.

16. The method according to claim 15, wherein the fermentation product is an alcohol.

17. The method according to claim 16, wherein the alcohol is ethanol.

18. The method according to claim 15, wherein the fermenting microorganism is a yeast.

* * * * *

UNITED STATES PATENT AND TRADEMARK OFFICE
CERTIFICATE OF CORRECTION

Page 1 of 1

PATENT NO. : 9,005,946 B2
APPLICATION NO. : 13/203909
DATED : April 14, 2015
INVENTOR(S) : Yang et al.

It is certified that error appears in the above-identified patent and that said Letters Patent is hereby corrected as shown below:

In Column 41, Claim 1,
    Line 63, please replace "161" with "I61";
    Line 66, please replace "1238" with "I238";
    Line 67, please replace "1287" with "I287" and "1296" with "I296".

In Column 42, Claim 1,
    Line 58, please replace "1418" with "I418".

In Column 43, Claim 7,
    Line 35, please replace "590V" with "S90V".

Signed and Sealed this
Twentieth Day of October, 2015

Michelle K. Lee
*Director of the United States Patent and Trademark Office*